United States Patent 12,576,115 (BACTERIAL COMPOSITIONS FOR TREATING AND PREVENTING HALITOSIS) - sequence listing, part 19

SEQ ID NO: 29 - DNA, 4093470 bp, Bacillus amyloliquefaciens (residues 2,046,736-4,093,470 of 4,093,470)
  source 1..4093470: mol_type = genomic DNA
gacccgccagctgaatcgccttaccggaccctaaaaacaacccggtgccgatcgtgccgccaatggcgataagctgcacatgccgattcgataagtccctctttagctctcgctgttccacatctgactcctccttacttttttatgaacgacgagaaaataaagccaataaaaaaagagattggatgccctccaatctcatggtcataagaatatcaaattatatttgcgccgctgacaatcaacagcatgacaaatacatattcggtactcttctgtccttttgcctgagattgtgaacccttcggcgccgcggaaaatccgcggtctctccagaagccgctcctgctgtagtgcgacccacagcaatcatagcctgctacgtattgagtttctgatagaaaatacctatcagctaactttttattttaatggaagtcgagtggtttgtcaatgttcttactctagtactcttaaactcacctatcctagcgactatattttccttttcgaaaaataccagggtttaactggcactgcttatggacagaataagcttaatctctcttgtaaaccttctaagacttctttcggtacttccctgaccttgatatccttacctaggaaaagcagccaatttgttatttcggtcaattcttcgggattactgacattaatataagtctctagaatggctgtggtttgataaggattcgtataggaaattgacatttttaaaggatgatattttttgaattgggcaatcgcctttggaccaagttcaagaacaaggttgattacttcttcctgcttacttagtttctctaaaatctttttcttgcttattctttttttcgcagagtatggtttgacattggtgagattgtccgcagggaaaatcctcctcttctcatcctttacatcaaagccttcaatcagccaaatgcctttttcatgataaaggtgcaagaggcagattggataagactttattaccttctcttctttgatggtaatccataaatagctatccgaaagaaggagctggatgagtttttctaacatgggatgggggagatctgaaagctcaagcaggtcggggttatgggggtttgtcccttcaaaaagcaagatttgatttaaaagaaccagggtctcttgctggctttctgagataaggcccagtaatttttcagctaaagattgacggctctttagataagggagctgctgatttcttgtggccataaacgctataaaaagagctttaatctcattatcggtaaagcgaacagcgggcaggacagagtggttcatgacaaaataaccgccgctccttccaacttcagcaacaagcggcatccccatggcttcaatttctctgatatctctaatagctgtcgaacgagagatattaaattcccgcatgatttcagatattgtaaagtgggcgcggttgttgatataccgcatgataatattaatccgttcaacttttttcatcgggacctcctaaacagtatcattttttgacatggtttaaggttattataaacgcatcaattgaaaagaaaaatcatttgattattttaaaaagaggaaggttttgaatatggaaaattatactctggaagaaaaagacggatttaccgtttttggtattggaactgagcttaagagcgattacacagactatgccggcataaacaaggaaaaggctgacttttgggaagccgtcaaacaagatggaaggcttgacaccttgaaagccattgccgcaaatgactatatttttgccgtgaacgaagcggtaaacaacaggttgatgcattatgctggcgtgatgacagaggaagaggcgtcagtgaccggagaaaccagagtcatccaatttcctaagggggaatacctggttgtgaaaggggaagggaagacggccgatgaattgagcaataagcttaccggcattgcctttggtcaggtattgccggaagcaaagaattttgcctatgtcggcgggccgaatgcaacggttgagatggggcagcgaaacggcttagtatttggtgaaatgtggattcctgttgtcaggaaataaagagataaaaggagagatggaattgtcctatatcgttgattttaaaaatgtgtctgctgttggtttagagtcttcacctgtggcagaagcgcttgctggtttacgtgctaatgaagcccgttacttaatgaacaaatacaagcatgaatttacggtggcaccagctagcgagtcctgcgagacccttgagtatgtaaaccgaattttgaaagaagaacgtgatattgagtttgcggccaaacctttagaaacgtcgcgtttccaagtggaaaatatcaaaatggcctacgtcttttatgaggatggccttgaggtcaacgtcatgtatacggttgatgaccctaagaagcgtgctgttggttttaagctttctgaggggatggaagtgccaaaggagttagaaggaaagtttaagtttgccaggcaaaagtctaaattagccggaacaattcggggctcgttttttgtcattaaaggagaatattaaagtaagcataaacaactattcatgcatcgaatgttcatctggcattcaaattacaaaacagcacctctccatcaaattgaaggtgctgttatttttttcgcttaaacttgccgctgaaattatcagcttcggcaccgcgaaattccgcggtctctccagaatctgcttcaaagcaatcatagcctgcgacaatgccgccatttcaaggcccttgaaaactatctgtttcattcatctcatctcggcgcctcttgccctcgttttgattgtctcaaaaaggcgttatgcggtactatcatataaggtctaatgatttaatcataatgtcatacttttaaattcaccttatcatgtaaatgctcgtaaataaaaaggggatggacgagattggaaacgaaatatttagatctgctcgcacaaaaatacgattgtgaagaaaaagtggtcacagaaatcataaatctgaaagcgatactgaacctgccgaaaggaaccgagcatttcgtcagtgatttgcacggggagtatcaggcattccagcacgtgctgcggaatggttcaggaagagtaaaagagaagatccgcgatattttcagcggtgtcatttacgatagagaaattgatgaactggcagctttggtctattatccggaagacaaactcaaattaatcaaacatgactttgatacaaaagaagcattaaacgattggtatgaagaaacgattcatcgaatgattaagctcgtttcttattgctcttccaaatacacccgctccaaattgcgcaaggcgctgcctgcccaatttgcttatatttctgaagagctgctgtacaaaacagaacaagccgccaacaaggaacaatattactccgaaatcatagaacagatcattgcgctcggccaagccgataagctgatcaccggtcttgcatacagcacacagcgattggtggtcgaccatctgcatgttgtcggcgatatttacgaccgcggaccccagcctgataaaattatggaagaactgatcaactatcattcagtggatattcaatgggggaatcatgatgttctctggataggcgcctattccggctcgaaggtatgtctggccaatattatccgcatctgcgcccgctatgacaacctggatattattgaagacgtctacggcatcaacctgagaccgctcttgaacctggccgaaaaatattatgatgataacccgtctttccgcccgaaagcggacgaaaacagaccggaagatgaaattaagcaaatcacaaaaattcatcaggcgatcgcgatgatccaattcaagcttgagagcccgattatcaagagacggccgaactttaatatggaggaacggctgttactggaaaagattgattatgaccgaaatgaaatcacgctgaacggaaaaacatatcaactggaaaacacctgctttgcgacggttaatccaaaacagccggatgagctattagaggaagaagcggaagtcatggacaagctgctgttctctgttcagcattccgaaaagctgggccgccatatgaactttatgatgaaaaaaggcagcctttacttaaaatataacggcaacctattgattcacggctgtattcctgtcgacgaaaacggcagcatggagacgatgatgattgaggataaagcctatgcgggccgtgagctgctcgatgtatttgaacggttcttacggaatgccttcgcccacccggaagaaaccgatgatctggcgacagacatggtctggtatttatggacaggcgagtactcctccctcttcggaaaacgcgccatgacgacctttgagcggtatttcattaaagagaaggaaacgcataaagaaaagaaaaacccgtattactatttgcgcgaagacgaggcaacctgccgaaacatcctgaaagagttcggtctcaacccggatcacggccatatcatcaacggccatacaccggtaaaagaaatcgaaggcgaagatccgatcaaagcaaacggaaaaatgatcgtcatcgacggaggcttctctaaagcctaccaatccacaacaggcatcgccggctacacgctcttatacaactcttacggcatgcagctcgtcgcccataaacactttaactcaaaggccgaagtgctgagcaccggaaccgacgtcttaacagtgaaacgcttagtcgacaaagagctggagcggaagaaagtaaaagaaacgaatgttggcgaggaactgctgaaggaagtggctattttggagaaactgcgggagtatcggtatatgaagtgagaaattttcagggttcagaggtgattctctgggctcttttttacggttttccgtaacagtcatactgagacccttccactttatttaaaaccgatttaaccgcttcttcaatctccttataacccgtacatctgcaaatattggactccagccaattttttatcgtttcatcacttgcatttggctcagtattcactaaagcatgacaattcattaaaaaacccggcgtacaataaccgcattgaaacgcaaatttctcaacaaaggccttttgaatcggcgtattgatgagtccttcaattgtcgtaatttcccttccttcaccttctgccgcaagcgttaaacaagatttcatcggtatcccatccattaataccgtacaggcgccgcaatcaccatttaagcagcccggctttgaaccagttaatccaagacgaagacgaagggcatataacaaagtatcggccggtctgacagtaatctgtctttcctggccatttactttcaatgtaataggatcagacatgtggacctccttctaattcatatagggcatctaagattgtatgctgtaaaacaaatattcgatagtcacttgagccttctgcgtcatcaagaataggtttcggcagatactgtaaagacctgcgcactctatcttctaatgagcagcttttatcgttaaacatagcctccatttcaacagaacgaaaaggaaatggacatacgccgctaaaggccattctaatcttttcatcttttttcagtgcacaaactgtcaccaatggatatccgacattccactgctgtcttctttttatactgacaaatggcaagtctgtatacgtccggtctataacgatatgaaataaaaaatctcctttttgcagttgtatttccctgttaaatattttatttataggatggtaatgaagccccgctccccctgcaatccccatcaaactatcagaaatcagcaacggcagcacggcctcacggtaatagatgcccccgcaaatatttccgcccaggctgattttatttcgagtcgtccgatccgcaatttcactcactgttttacttaataacgggaatggattttcttcctccactttcgttaatgacacacccgctccgattaccagatcattttcataaaaaccaatggtatgaaatcccggaagtgcgttaatatctatcaccgcatccgtatagatgagattcagccttcctaacgttataatttctgtaccgccggaataatacattggcgttttcttttcggccgcaagagagtgaaatagattggttgtttcttgaatggtcttcggtttaaaatagtcaaaatcaaacggtatcatctttccaccccatttgcgtcctccataattgttcgggaatgagagggagctgattcaattggattcctaatgcggcagaaaggcaatttcctaatgcggccggcatccccaacagtccatgttcccctgcgccgcgtgctccataaggcgcaataacatgcggggtttcaacaaattcaatgatatattcaggctgctctccatagtgaaggggtctgtatgttctaagttgaggatttaatactcttccatatggatcaaaaacaaaggtttctcttcctccaaatgcgattcccatactcatcccccccatcacttgacccaatgcagctttttcattcaatacagttcctatatccacaacagaataagcttttgtaattcgatacgtataatcccgtttatccagctcaacttcaattccctgagcacctacagcccactcgggtcccggctttctttttcctgtttccgggtctaaattcgtcatccgggttaatgtgtagctgccgctcgccataatttgcccgccaatggtatttccatttggaaacgtatatccgtaagcgatgtcttttatttcaacatacacattcggattatctaaaaaataaacctttccatcagccacttctaattcctcgacaggaactcttaaaacacatgatgccacgtccttaagctttcgaatggcttcctccgctgcattcagtacggctcttcctcccattaaagtccctctgctgcctacggttttccaatgctcaggtgttgtttgagtatctataagcatttttacgtgaattttacttatatccattttcattcgttccgctaagatttgggctaacactgtttttgtccctgttccaatttcaactacccctgacatcaaattaatgcttccgtcaggattaaaggttaaaataacccctgaagttgcatttgtatcaaatgttgacgttttccaaatacagctgatcccctttgcccgtatcttccgatcaccgatttcaattctctgtccctcatcccaattcattaattccttcaatctttcaatacattttggtacatttccgaccgtgcttgaattgagaagaacttgagtaggggtcgtgtcaccgggacgaatggcatttttatagcggagttccaacgggtccatattcagcttttccgccaatacatccatcgtccgctcaaaggcaaataaaacttcagcatgactgtagcctctatatgcactgggatatggatgattcgtatacatacaatatgaatcacaccatacatggtcgattgcgtatggacccgtacaatcaaccactgcggctcgactgacgtcaactcctttatcagagtatgctccgctatcaaataaaaactgaatgtctgccgcctttaagattccatcctttgttgcgcctaattttacaatggcatccaatcctatatgagcaggagacgtgatcatatcctcttctctcgaattaaataattttacggcccggcctccagctgcttttgatgccaaataggcaataacctctaactgaaccgctgattttcccccgtatgcccctcctactaaaggtgttttgacgataacctttccgggttctattccaaaataccactgcattaattttttaatggcaaaaggagcttgagaggatgttgtaatggtaatgtccccatccgcttgaatttcagcaatcgagcatcttgtttccatagcagcgtgatcagagggattaaaggaaatgttgaactctgctgtcacatcactttccctgaacccgacttcaatatttccttttctgactttatccaggtttgcgatattcgtcttcggaacgggataaacaccttccttcttctcataacggtccaaatgttcatggacgaggggagcatccttttggaaggcctccctgggagaatttacgacgggaagaggctgataggacaccttgatggcatgcactgcctttttagctatgatcggattttccgcaacaacaacagcaaccggctcaccgtggtatctgacttttttataagcaatcggcgacctgtctttaatttcttcaccgacaagcggaaaaggttcatcacccaatatcgctatcactccgggaatcttccaagcttctgaaaagtcaatagaagcaatatcggcatgagcatatggactgatcagcattttcgcgtgcagtgcacctgtttcttgaaaatcatctgtatatttcgccttacctgtcactttttcaagggcttcttttcgaataacacttttcccgatataccccaactcattcactccccgaatttattcagcagcagagtataatcttcaattgtatctacgtcataaaaaagcaaagggtcttgaaagctgatcatttttcccgtattacttttacggattacataccgagcgccttggtctccctttaactgatgcaatagcggaaaacattttctggagaataggatagggggcataggaagatgttgattttcagcagcaataaatgaatagcggtgctccttttgataggaatcaattaacgtattgatgatatctgtggtgacaaatggctggtctgcaaggagaatgataacggcgtcagcctcatactctaacgctctttttaacccacattgtatggagtagccttggcctttatccgcttgttcacattctacttggctccacttatttaccataggatataaaaagaaaaaagccgagagccaatgcagtgaatctccctttctggtgataatgaaaatatgatctaatttagataacaaggcatttttaagcgccatacttcccagagaaactccattgagaaataaacttcgcttatccgtccccatacgtctgcttgtaccggctgccaggtaaatggctgctgttttcataaaacagacccttgttttcgcatttttttgatcatctcgccaacaatacttacagcaatttcctcagggccttgtgcgccaatggaaagtccgataggggaatgaatatcctcaggaatctcagccccgcccaataggcgtttcgtgcgccttctggggcccaatacacctttataaaacacatcttcattttcgaatttatgtaaaatggtccgatctttttgaaagctgtgtgtcattatgataataaaatccctgtgtgtaatgctcaggccctccattacttcttccagtactccgacaatcaaatggccggcttcaggaaaatggccgttatgacataaagcaggacgccagtcaatcaccgtcacatgaaagcccgtaccagccgacaaagaaaccaatggcttagcatcttcgcccgctccaaaaacatataaacaaggttttggaatcatctgatggataaaaaataaatcagatgtatgttcatcctttttgattcccttttccgtatcataaagggggtttttcagtttttgaacttgctccataaaatctccggttccaaacacgctgccgtcttcagctatatacatatcttcctttggctctaacgtttcagtgaatcgtttcactcgggtcacagacttttttccatctaagcatttcttgactgtcagcagatgtctttccaattcccctttgacaggctcaagtaaaaccgtcaaaacaccattacagccaacgccctgtccccaggataaatcgtcctcagcactcatatcaaagtgaacaatcactggctctcctgcagcccaaacctgctctgttctttcagcaagatcgtcttccagacagccggcggataacattccgactcttgttttgtcccctaacattaacatggaggccccttctttcttataagcggacccctctgttttaatgatggtagccagtaccttaggttttgcagaattcgcgatgacatccaaaatccggtgtatatcatccattttgatttcccccgcttttacctgatcatatctgcatctgtataaccatattctttttttccagaaaacattacaaacgtttcagcaatttcttcgtttctaaaaaaaaagagtctttatagaccttatgatcgggcggcgggtacaacagcattttggaacggagagattccaataacatgttctgttccttctgtttccaattgtctgtttcaccctgctgtattcctttaaaaccctcaaaaaattcacttaacacttttaaatcattgcccagctccattttgtcacatgaagataaaaggccttctttttcccattcttttaacgttttcactatatttgatatatactcataccctgcattcatcttttgtatctctatttgatatcttgaaagaatgattttatgctttttacggattggattgaattttaaactgtcagaggctgtttgcagcatctcttttgccgtatgcagctcctgcagaagattgttcattttatactccacaaggttcccctttccttgtccccactctgattgaacccatttggaaaggtctgaaagtgtgtcagaaagctgacgagccaatgatcgaaatgactccgctgccttttttgtaaagtccggcggaaaaaggaacatatgaaccagaatggcgatgatgacgccgatcaccgtatcgatgattcgatccattgcataatctttggagtgtcgttcaaacgtaaataccaataaaatggtgagggctacctgatgtaaaaccgtttcatctattcgtaaccaccttgcaatataggtcccgcctaatagtaacagccccagcatccagccattcattggcaagtgactgacaagataggatgttaacaagatcccaattgcagttcccgcaatacgatgaaaagaaaatcgaatcgactgatctatcgttggctgcaaacataaaataacagatagaggtgctaaataggggtgatgagagcccgccagttttgccgcttcccaagaaacagcagatgcaagcgccatcttccaaaccaacgatgtgttgttttgattttttttacttttcttcataagccccctcctttcagaaaccttttccactaggtttccgttacgcaaagggatttatactgatatatggaaaaagcgaaagaagggagaacgttagcaaatgatacattatttactactctttgcaggtgcttcacctttcttgatagctttgccccagatatgaagaccgcccccctatgactttcgaagggaaacacacaaaccttgttggttaagcgcaatggaattgggtgaattttttatcattttatatggtaagggtttaagaagcagaatgcctttgttagtatggcaaccaaaggaggaggatcaattatgcaaagcagaataaagctaaccgcagtgaaactggcagccttggtattcctagtaggtgcctttgccctcccggttttacctcatgctgcggctgccgcagaatcccaagctacatacaaagttgaaaacctcaacgacagtgagctgaagatgacgttcaatcatgcagatgttcatattgacgctaaaggcaatgcaaccctaaaagacaacataacgggcgaggagcaggctcttccgaaaagctctactgacaaaaatggtgaccccgttacactgaaatacgaaaaaatcaaaaatggcgttttagtcaaagtagtaaacaaagactctggaaaaacgagcggggcaatcagcacccaatcagtcgggaaatgtattttaggtactggcggcggtgcggtaactggcggaggcacactgggtcttgcaggagctgctgtaggaaccgtcacaatacccggcatcggaacagtaggagcgggtgccgttggagcaattaccggcgctgttggcggcgcaatgacaggagctgccgcatcttgcttttaatcatgaagaaaaaggggcccgcgcccctttctttcactaactatggaaggtggtcaacatgtacaaaatcatcattccttcaatactaaccatcttcattctctggatactcttacagatttccctggagataagcatcgttaagaatccattgaattattttattgtattcattgtcttctttctctttataaagatggtgaaagagaagcaacagtagtttgcaactaataagctggaaaccagatttgtgttggaatctggtttttttgtgtttttattcactatatataaatcctttgctgaaagacaacaacagaatcaacagaaaactaaactctaacggctattttgtcaaatcggtctgctaaatgttattagcaaaattttcattaaaccctatatcaaattacttgatactatagttaatttcgctcgatctttcactcacaatttctgcaattcttttgcttcaatttcaacactaaatcccgttctctttaacttaaaaatcaaatcctcagaaaaatcttttaccttatacttatcaataaaaatagttaaattgctttttgctcttgagcaaccaacataaaaaagtctgtacgcagacagaactccgtacacagtactctctttaaaacattttttaaagtttgtaacattaggttttagaagatatgcattgtaaaagtcttcacaaagatctttaaatatccaattattctcgaaatatttgcataattcttcaactcttgtttttagataagttgcatgtgcctcatacttttctttattcaaatctgatattttacatgctaaatggtcaattgtatcttcaatccactttttataatcataataaaaggattctagagaatctaacgatagttctgtaatagtccatagttttaagaatttatacatatgaaccagcggtgttctaaaggaatcgtccgcaatgaagaaaacagtattatgactctctccttttacaccatgttgtgtcgaaactttcgggtctttcaaatagtttgacagtgccttgaattcgtttaatgtaactgctaacactccaatatattcattagatatattatctatatattcctcttttataactctagagcctcttaataaagttaaaaattcatatattgagctgtctttctgataaaaatcatatatttgttttaatagattgtttaagttaactttatcctgatgactagtaattgtaccaattctagtatcaaatattttttgattccttttaagggtttgaattatactgccaagattaaaatcctcataataacttagaattttatctactataaaaagcaactttaaaagaggatctttattttcatttgtattatcagataagacatcactagcatttagttggtttacttgtgaatatctatccaatctattaaattgtctgtaaaattctccagcgcctatcgaatcaaacctttgttgatttaataaaaataacaataaagcattcggataaattaattgttccctttttattcttttttgaatgttatcacacaatactactcttggtggatggtctggtttattagctcggtttttatcggatgagatttgtttgaattccttatcattatatatattatttaatatagaaacgatatctggtattgaccgatgattagtatctaatttaatttcattatttagagtttttaattctttttcaaatgacccatcatagtttttatatatttgttgcattttgtcgccaagaaaatagagttttgagctagtatttagtcctgctttataaaacattttaatacactgggagcagagtcttggtactcatctataaaaatcaattgatacttttgagttaatctcttcttgattttaggaaacttttcgaataccttttctgcaaatatgagcaaactatcgtgagacaaacctcctttgtaaagatgattgtttgaagtttcattataataaatagaacttatattagtttttatcacttctaaggttaaacaaccaaacttatcgatatacttcttgtttctagctagtacatgttctttctcttccttgttctcaatattccctctgattaaatccccaaataactccatatataaatctatcatttaatttttacaaaaatagattcttaaaaatttatgtaaaaatgaatgaattgtgcttatgtgaatcccttcttcatccagtccctttttaagctcttctgcagctctctttgtgtaagtaatacaaagtatattatcaagtggatgttttatcttatggtttacaatcattgattttattttagttgttttgccactacctgctggagcattaatgagaaaaatattatcaactaattttgcagccaatctaatccctccttaatataattaggaagcatcttttctattagaccatttaaaataactgagtacataaaatcagttttattattctctgaatgtctaacaatatctctaatactgtatttttcatctttatctaaatcatcttttttagatttatcagggtttggaatagtatatttaagattatcgctatttcttttctcaatccagaaacttctatcttttttttctaacacattcaaattataaaattttgagagcatagcttcttctaaagtccgagcatattgttcagattttccttgataattaattaggactaatcctccaagaatcttattctcacctttgtctttccattcatacaaatcaagtattgttggagactttatttcttttgataaatcataataggtgttgattgttgcatttgttgttttagactcttttactgcttctacagttgttgcatcttttttataatctagatcagttaaaacaagagtttttatcttcagaaaatttatcaccttactatatttatgtgcgtatgctccgccaacttgaacataggctatgtatttttggttaagttcttcatatatatctagagtcaataactttcttataagcaacctttctgtgtcaccctcatatagaattactctatctgcaaaaactatttcagaaaatcctatttcataaaaccaatcataaaatgtatccaaagtggtgtcaccactcaagccttttttaaacatagaaaaatcgtaaattttactttctaactgatctattggtcgtgaaactcttaaatttttcatttccgttaggcgcaccatttctccggaatgagtagttattaacccctgtatttttttttgaagatagtaatcttttaaatacttcccaaagattcgttgcatttgggggtgcatatgtgattcaggctcttctaccacaaataggttgactaatagcggatcaatttttcttttatatgtttccaactgtagcagtatataaatcatattactgtaacctaatccttgggaggcttcattgaggaaataaccttcatattgatatttagtgttagttatttgattaagaagagaggttattgtgccttcgttaatatctatatcaaggatcatactccctgtattgcctccacttgctttagcaattgttttaaccgcattgctaagacctttcaccgatgtgtctcttaccttatcaataatctccgtatcttgtattggacttagtatttggtctggtaagttctctaatagggcacctagtttttcatcatgagttgcgagctcaaccatatttttacttaaacttttaaagttaccattactctgatcatcgagtggtctacctgcattaatatatctaaaattaaacagtcttcgaaaagttgaaatgtcaatttcgactttatcagtataatcgctatcactaaagtaacatttctcaattatactcgcttcataaattgacaatattacctctttaaattgtcgtatttttaatgttggatcttttgaggaatgaatttttttatatcttgcatataattttttataattttcctccaatgcttgtccaaaggatacataagtaggttgaaatgaatattcaaaatagaagcttttattatccggattcaaatccataataaaatcggcaaactttctaatatcgtcctcttcactataatctattctaaaacgtatagatgttgcaggtattattagatcacattctaaattaaacaattcagtactaaatagcttgtttataattctctctactgtagataattgatcatcgccttccttaaagcacagtataaaggtctcataaacttcatctacccattgttttgatagccttactggtatatccgaaataaaaaatggcgttttgccattttgcattatagatccaattaaattaatcatagaagtcttaccactattattagcacctgcaagcaaggtaacgtcgtcagccattgaaaatgcttcgtttttaaacttcctataattttgtatagtaacaccttttaaaagcaatttaagaacccccagatgaatttccgattttataaaaccccactcacttatgataaggctccccacgattaatccgaaacgcccgataaatctgctcaactagtatgagacgcatcaactgatgaggaaacgtcatcttcgaaaatgacagcttgtcgtctgcccttttcatgacggcgtcgcttaggccgagtgagccgccgatgacgaaggtgattttgctttttccataagtcgccagcttatctattgtatcggccagttcttcggatgttttcatctttccttcgatggcgagggcgatgacgtgggtgtccgggctgattttggccaggatgcgttcgccttctttgtctttgacgattttcatatcttggtcgctcaggttttccggggctttttcgtccgggagttcgatgatgtcgattttcgcgtaggctgagagtcgttttttgtattcttcaatgccttgcttgaggtatttttcttttagttttccgattgtcacaatattgatattcacaggtcatccccactttagaaacaagttattcatatatattgtccacaattgtggatatcttttctgtattttgtgtaggatcattcgttccctactagatatgttgcggtgtccccacataattcacaggctgtggataaactgttagtatgttcgatttttctgatttcgggcggaagctcatgatcatctatgtacatgtccagcacggtttcgatatgttcttcacaagaataataagcggttttcattgttacatcctccggttttcttttgcacacggcaattgttctcttctcaatataacctatttatacacatgttagtagtgcttcgggctgagttttatccacaattcggcaaattccgcgcaaaaagagccggcgtttgcagcatccggctctttacgtgttttctcttttttctatgcgaagtacgaacagaattcctaatatacacgccagcagtgcagagcatacattaatccagtccggctttccgccggttaaaaaatagttggttattacggaaaccaggagaatggttacggtcaccgcggcaagctttttcttcatcggctccctccttcacctgactgtcttctgcttttacgggtaaaattcctctatctctatgttcggtcggctttttttcttgctatttagtcttattatgagggtcacaacgatatatacaatcataatcaatgtcccgttactcacatcaggatatccaatcaacatattcatcatcacaaaaacaattgttatacatatgacggacaacaataagaagatactgaatgatttcaaattaaacaccttctttcttgcagtagcgtttcattaaaaaaaagcttaccaaaagcggcaagctcttaccaaatgttcgtacttcaaaacccatccatcacctgcacgtcatacagcttgagatggcttttcggcgtgacgatgtttttcaggtttgggatggtccggtcgttcagctttttgcccgttttcagatcgaaggattcgattttggcgggttttttgtagctgtacgtgaagagatacagctttccgttttgatgggtcaggtctttgaaatcagccttcattcctgatgcagggagggtgaaggcttttttgctttttccggtttcagggttgatgcggtatacggttccgaagccgtcaacgaaatagaggctgcgctgctccataaaaaagctgtttttgaagctgaacggcatggagtcatagagggtctgttcgtcatttttataagaggcgatgtcatacgttttgatagcgccgctgtttctcatgactttcaccatttgatagatgtggtcggctttttctcctcttgtgagaaagtagacggcgctgtcatcagcggcgagctgggattcgacagacgtgccttctttatacgtccatgtcgcgattgtatttgtatggagcctctctttatcggcctgaatgtcttgaacgtgatagcctttttcgtcatctgtcggcgtgagtgcgaaaagatgatctttaaaaaagcctgaggcgcggatatagtgcgggatgacgtcttgcttccacttgccgtcaatctggcggtacagctctgagcgatagctgccgccgcttttgtcgtagcctgagttatacagcgtgtagaagccttccgtccggtcaatatatcccgcgctgtcccccgtatgctggtacgctcttttatacgtgtgaaggccgtcctgaacagtgtaaatcccttttttgtcctccagcaggacgctttcgtcatgcactttggccgatccgagttctagccctttcatttgataagaaaagagccggccttttttatcagcaaatagagcatagctttttccgccgccgaacgtgtcctggtcagccgtagtggagaaatacagcagcgcctctttatctttcagaaaatcaggatcatttaatgtttccctctcaacctccgcaggctcttccgtgcgaaaatggaagaagcataagaccgctgcagcgatgatgatcactaagggtatccagatgatttttttcacgtttttctccttagttaatggtgagaatcgttgtcgtataaggtgagcttgtgatgtcgcgcggatatacgcccaggccgccgttagagtcaatgtcgattccggcttttaggaggaacgctgaccacagcagtttcgagcagtttttggcgccttcatggcctgtatttcggttattgacgaagttgaaggagtactcgtcgccgactcgtgatacggcccagtcagcagcggcttgtttttgggcatcggtgactttcacggtttgtacgattgaattatcctcgacttctcttccgttataggcgatttggcggacgccgtctcccggtacggattcgacgatcttatcagcggcagaatacatgccgacatggccgtggttgtaataggccgtgtatgagttcgtgtaataaatattgccttttgtgcttttcggaagttttttggtgcctgacgatccgcccatcgcagatagcccttctttggaagcgtttacatctccttgcaccttgtctgccgtaatttcttgatgaaactgcttgagaatcgcttctgttgacacgtgcttctgtttggcgagctctttggctgattggagaacgtcttgaggggtcgtgccctgctgaagctctgcgatttcttttgcatagcgggatgtttctgtttctttcgcttttacattcataccggagaaggacagaaccatggtgaatgacagggcaaacgggaggacggctttgaacagctttttacacatcattacttcgcctcttttcttagagtataatttttccacatatgcattatatgacagaattgtgataaaaaaatagacaatttacagatttttaaaattttataacaataaggaaaagatatgcataaaaccaccttgaaatatcaggaaatctggttatcatatacacaagataggaaagggggagaaatatgaaatacagaacaatcggttcgatgcgggtttcctcattggggttagggtgcatgggcatgtcggaatactacggcagccagagtgaggaagagtccatttccacactgcatcatgccgttcatctcggggtgaatttgtttgatacggctgatcaatatggattgggcgcgaatgaagagcttgtcggcagagcgcttgccccgtacagaaaggagctttacctcgcaactaaattcggctatgtccgaagtgaaaagggcgagtttattgaaatcaacggccggcccgattatgtcaaaaaagcgtgtgacgccagtctgaaacgcctcgggacggattatatcgacctttattatctgcaccgggttgatccgcgggtgccgattgaagagactgtcggcgctatgaaggagctagttgaagaaggaaaggtgaggtatatcggcctgtcagaggcttccccagaaacgatcaggcgcgccggccgcatccatccgattgccgcgcttcaatcagagtattctttatggagcagggaagcggaggagcatgtgctgcccgcctgccgcgagctcggcatctcatttgtgccttacagtccgctcggcagaggttttctgaccggaaagatgacgtcgacagatcagcttgatgccgacgattacagaagaagaacaccgagatttcagggagacaatttggcggtgaatataagactcgtccaaaaactgaccgacattgcccgggaaatgaatatgaccgcgcctcagcttgcgctcgcatgggttctcgcaaacggtgatgatctcatcccgattccgggtacaaaaaagaaacattacttggaagagaaccttgccgctcttgacattacgcttcccgaagaagtgaaggcgcagttggatgagatgtttccgatcggcacggcggccggcgagcgttatccgcatcatatgatgacattgttagatgaataacaaaagaggcccatcgtgcgggcctcttttcatgacagctttttgctcatgattacatccgtctccaggaatcccgtcttctcatacagcttccgcgccgtttcgttatgagcgaacacatggagagaaagcttgcggacacccaggtcttttgccttgtcctccagccttgcgatcgcctcttttgcatagcctttgccgcgataaggaggatgaaggccgaaatcataaataaatgcgtcctgctgcgggttgtccggatcggcgtgcagccacagccagccggcattgtcctttccgtccaatgtcagcgtccataaatagtggtcagccgtctccaagccgtcaggaagcagatctttaaatgtccattctgctagttccggcgcttcttcaggcagccacgttcccgcttttatcttttcttcagcgtaatgctttgttgaatgggcgagataggattgaaattcttgctctgtcatcggctgcagtgtgatagccattgaatcactccttacaaaacacagactgaaagcggtatcatgcagtattatccgaaggctccgttttctgcgggttttatgatttgttcggcttgcgccgttgaaccagtttgtgcaaataatccaatcgaaatgagacttgccaaggctgctgagagtacaatgaatttacatgttttcattacgaatcccctccgtcaatctcaaaatttggtcattagcatctattgattcttggaaatacttcgccgccagtttgtaattctcctgttttttaaaatgcgcagcggcctgatacgataaatcggaaacgtcactccacagttctttcttttttaactcggcgaacgctgattcaagcgcttcttcactgtgatcaataaagacatgctgtaagatgcgcagtttttgggtgtacacaggttcatttttttcgtctgcggcgttcagcgctttatgaagccaaaaccggccctcatccgcctgctcctgcttcaataacactctggccagcatgtacagactccgcaccgaatatgcggattgcaaatgctcctttttatcgagagccgtttcaaactcgactcgcgcctcctccaatttctcctgtctctcataacaaatgcccgcgttaaaatgggccagcgcctcaatgtgcggatcgcctgctttggcggcttgatgaattgccgtctgcaggagctcttcggctttctgatagtgaaacaagtccattctgttacagccgatcaccattaaacactgtgcttctctgaccgcgtacatttcgttggctttgtagatctctaacgctctttccgcatgattcatcgcaaagtagttttggcggatttcatagtaggcaatcgccacttggtaattaaactcggctctttcaatctcattcggtatgtgccggagcctgctttcagcgatccggtaaaaattaatggcgttcatgaatcgtttccggtaaaactcgtgcattccggaaaagaaataataatagtattgaatcatctggtctgttttttctttatcggcgttcagctgaatcgtttttaaaatgccgtctgttttctcatactcttccatcaaaagcttatagcgggaatcaattaaattaaaataaaggagcaccgtttgattttgtgtcatattttgcagatctgtaagcagctgttctcttaacgccttagccgattcggttttgtgctttttgatttcctcgtaccagtcactgatttttttcgcaacagtttcgtgggccatcacctcagccatctgtcaggacacctccctttcccattttgtgtaataaatatatcatatttacaggctcaaaaagagggtgacagcctgctagtttcctagtggcaacaaaaaaacccccgcaggtgcggaggcgcatattttataatagtttttttcctaacaaggactccaccagctcaaccgctgttttgccggttttgtttttgtgatcgaggatcggattgacttcaacaaattcagctgaggtgataatgtcggcatcatacagcatttccattgccaaatggctttcacggtagctgatgccgccgacgacaggcgtccctacgccgggcgcgtcactcggatcaaggccgtcgagatcaaggctgagatgaacgccgtcacagcctgacaggtagtcaatggtttcttccatgaccctcgtcatgccgaggcggtcaatctcatgcatcgtatataccttcatgcctgtttccttaatgtattcacgctcgccttcatcaagcgatctcgcgccgatgatgacgacgttctccggcttgattttcggggcatagccgcccagattcaccaatgtgtcgtggccgacgccgaggctgacggccagcggcattccgtgaatattgcctgacggcgatgtttccagcgtgtttaagtcgccgtgcgcgtcgtaccagataacaccgagctgtttatagtgcttggccgttcctgtcagcgttccgatcgcgatgctgtgatcgccgcccaggacgagagggaaccgctcactctcaatgacgctgtccaccttttgggcgagctgctcgttacctgagagcacagagttcagatttttcagctcttcatcttttttgagtttttcacgattgacggggatgtcgcccaggtcttccaccgcataccccatgtcagataaccgttcaatgagatgcgcgtagcggatggcgctcgggcccatatccactccgcgtcgtgcttgtcctaaatccatcggcattccaataactgagatattcttattcatccgtttttccacctcaacatgttgtatgttgtcctgtgcgggtttctcaaagatgacttggacacgaaaagattttaaagctctatctgtttttctgactgtttatgcttttttacatacagatgatagacgataacgcacactaccatgaacgggatgccgcaataaagggcgagccgctgttctgaatcaaatgcgagactgatcagaacaaccgtattcaacgtcagcccgataataggcagcaccgggtacagcggtgttttaaacttaaggtcttccacttttccgccttcacggatgtatttccgtctgaacatcaactgcgacagagaaatcgcaatccagccgacctgcgcgcttaatccggccaatgataagagaaacatataaacggctgccggcgctgcgactttagacagcagcgacaggcaggcgacggccagcgtcacgatcagcgcattcatcggcacgccgcgtttgtttgttctgccgagcgctttaaaggcttgcccttcgttcgccatggcatataggatacgcgttgatgcaaacaggcctgagttggccactgacagcagcgcaattaaaataacaaagttcatgatatcagcggcatacgggataccgatttgttcgaacaccacgacaaacgggctttcgaccactcccgcctgcttccacggaatcatgccggcaatgacaatgatggaaagaacgaaaaagacaagcgttctccataccgtctgccggatagagcgcggaatcgttttctcgggattttcactttctcccgcggcaaccccgatcagctccgttccctggaacgcgaagttgacggtaatcatcgtaacaagcatagctctaatgccgttcggaaacaatccatcctcataaaaatgagagaagaaaggagccggctcgccgtgcttcatatcaatcaggccgaacatggcggcgccgcccaaaataataaacagcagaatgactaaaattttaatgccggaaaaccaaaattccgattcagcgaacgcttttgtcgtaatggcgttcaaaagaaacatcagcccgacaaacacgaggcaccacacccacacgggaacatgcggaaaccagcggagcatcaattggcccgcagataaaaattcaatggcgcatgtcaccgcccagccgagccagtacagccagccgaatgcgaaaccgaaagcggggctgataaatttggttgcgtacgtctgaaacgaccccgatacgggaagggcaaccgcaagctcgcctaagcagagcattgtcaaaaacataataaaaccgccgaccagataagacagaaccgcacccagcggtcccgcctggttgattgtaaatccggtactcaggaaaaacccggtgccgatcactccgcccaatgaaatcataaacaaatggcgcgatttcatcgtgcgctgaagctgattctctttttgatttgtattcactgttctgcaccccttcagcaacttgtattggaaccaagccggtgcattgaaaccgatttgctgtccaaagagcctctatttgtatatggatgttatataaaattcattttcgtacataaagatacattatactaaaataccgtcgccgcgcaaatagagtgtgatgaatttttatttgtaaattccatacaagccgagggaaagcattgccgcatcaaagttttacgcgttttgaagcacatttgtgatcttttggatcgcccagtccaagtcttccttggaaatcattaacggcggtgcaaaccggatcacggtatcatgtgtttctttgcataaaagcccttcgcctttcagcttttcacagtatgggcgggccgcttcggtcagttcaacgccgataaacaggccgcgtccgcgcacgtcttttatgatagggttatcgattttctcaagctcttctttaaaataccggccaagctgaagcgaacgctctgccagcccttcttcctcaaggacttcaagagatgcgatcgataccgcgcaagcgagcgggtttccgccgaatgtcgagccgtgggaacccggattaaacacgccgagaatgtcacggttcgccgcgatgcatgaaatcgggaagacgccgccgccgagcgcttttcctaagatgaacatatccggtacgatattctcccagtcaatcgcgaatgttttccctgtgcggccgagtcccgtctgtatttcatcagcgatcagaagcacattttcttccttacaaatggcggccgcttcttgtaaaaatccttccggcggaatgacgatgcccgcttctccctgaatcggttcgaataagaaagcggctgtgttcggcgtaatcgcccggcgcagcgcttctgcatctccgtacggaattaattttatacccggaagcataggtccgaaacctcgtttatactcatcttctgaagaaagagataccgcaagcatcgttctgccgtggaagttgccgatacacgcaatgatttctgcctgattatcggctacccctttgacctcatatgcccagcgtctcgccgctttgacagctgattcaacggcttccgcccccgtattcatcggcagaatcatatcttttcccgtcagcttggctgttttctcataaaacgggccgagctgatcattatgaaacgcgcgtgacgtcagagtgattttatccgcctgatccttcagcgcctgaatgatcttcggatgtctgtgtccctgattcacggcagaataagcactcagcatatccatatattgattgccctcagggtcttttacccaaacaccctgcgcttctgaaataacaatcggaagaggatgatagttgttcgcgccgtaatgtgaagtttgactgataatttcttgagattttgtgaaagctgacataatctgattcccccttgttttgtaaacattcaacataagctcttgctttccctttttataaagcaagttccgtgccaatccgaaaaaacgggatgtttcggcaaaattctttctcttcctgcaaaattttcatgcggtttgcaaccaaagctcagcaaagcgcaaaatttttttgcgttttcgctgacaaaaataagagcaatccaattagattgctcctattcagcagttatttattcaattgtctttgatatacaatataagaacttaatacagaaaatatgatacagccgattgcagcaatgaaaatggctgatattctatacactggcggaaaaaaagctgaaagcatcatgataatgcccgctaagacaaaaagttttgaactaaccctgtgtgtatccttccaaactttttcactgctcagcgtccacggtgttcttatccctaaaaagaaattaggcttaactatctgaataaagtttccaaacaccataaaaataacgcccactataaagcttcctaaataagatatagggaggtcatatcccaggccggtcaagatgatcataagattaatgacaaacattaccgcaaacattgtattaaatatagccatatatggcccgataaatgttttgtagttatttttaggatcaatcttagggatgataaccattaaaatatatataataatcattatgccaataagcatcatcatcgcattagctttagcttggtaatcatttgcacttccgtttaatccccagtgtatcgccaaattgtccggtaaagatgaatatgtgaaagcccatgttaaaacagttaaaacaatgagtcctgccgaaaagatatattttttcatgattccccgcctttcttcttatcatgttctggttcagccaaagaaaagaaccagcctataagatcctgtaatacagtggtatttaatgaatacataataaattgacctttcctctcatcgtgaactaaatcagtatttttcaatatgttaagatgatgagaaatactgggttttgacatttcgaagtgttccgcaatttcaccagctgtcatgtcttgtttcttcaataaatctaaaattcttctccttgtaggatcggctagtgctttaaatgctttattcaagtactttccccctctcatatatgatttagatatttaagtatatatctaaatatcaaccattttcctaaaaaagtcaatggtttctttacctcaatttccatttatttttaaaaatcagcaaagcgcaaaatttttttgcgtttccggctcaatttattttaaaataatgaatgttaagacgattgggaggggaattgacctgcacacaaccagcgaatttttcacactcgtattacaaagcattctggaagagattgatgtcgggctgcatgtggtagacgaaaagggcagcaccgtcatttacaataagaaaatgatgcagattgaagatatggatgaacgggacgtcctgcataaaaatctgactgatgtatttatgttttccaatcagcaggacagcacgctcgttcaggcccttcaggaaggcaaaacgattaaaaatgtgaagcaaagctatttcaataacaaaggccaggaaatcacgacgatcaatcatacctttccgattgtgcaaaacggggagatcaagggcgccgtggaaatcgccaaggacgtcaccaagctcgaacggctgatcagggagaacatgcacagaaaagaacagaacagctatacgtttgacagcattctcggcaacagtccggtcatccgggaagtcatcgaaaacgcaaaacgggcaacccgcacgtcttcatccgtgcttttggcgggtgagacgggaacaggaaaagaactgttcgcccaaagcattcacaacggcagccagcgctcaggcgccccgttcatatcacaaaactgtgccgccttgccggacagtctggtcgaaagtattttattcggcacgaaaaaaggcgcctttaccggagccatagaccagcccggcttatttgagcaggcacagggcggcaccctgctgctggatgagatcaactctctcaatctcagcctgcaggccaaactgctccgcgcccttcaggaaaagaaaatcaggcgcatcgggtcagctcaggacaaaccgattgacgtccgtattatcgccacgatgaatgaagacccgatcaccgccatttcggaagagcggctgcgcaaagatttatattaccgattaagcgttgtcacgctgatcattccgccgctccgggagcgcaaagaggacattctgccgctggctgaagtatttatccagaaaaacaatcacctgttccaaatgcatgtcgattcgatcagtgacgatgtgcagcaattcttcctggaatatgactggccgggcaacatccgtgagcttgaacatatgattgaaggcgccatgaactttatgacggatgaaacgacgattacggcggcccacctgccttatcaataccgcatgaaaatcaaaccggctgacacggatgccaaagccgctccaaacacccagcccggcaccgatttaaaaggtaaaatggagaattttgaaaaatatatgatcgaaaacattctgcgaaaacaccgcaacaacatatccaaaacggcacacgagctcggtatcagcagacagagcctgcaataccgcctgaaaaaattcgggctggagcggatgaaatgaatccatactgaaaaaaggctgagatgctcctcagcctttcgtcagcctatgtctgattggcttgatgccaccactccattacctgaatttgtcattctggttcaaagctcgactttattctggatggcgacactcgctttcagtctgtaaaagctgagcatcataaacagcgacaataagatggataataccccgattgcggtcagcagcaaggctgaatcaaaataatccgttaagaatccgataaacggaaaggcaatgaacatgaagagagaggtcatcaaactgataattgacagcagcgtggctctcgttcttgacggaatctcattattcactacctgactggatacgggctctatcacatcatagagcgcattaatgacgacaaaagcggcaatcgtcacatacagactgcctgaaggtataaacagataggctgccccgatgatgcagaatgtcagcagaagcacgcgcctcggcgtgaatttttccgccggctttgaagaaaagatggagcacagcgcctgcaagatggacagtcccgcaaaaataatggatatattgcgcacggacagcccttcctgacttaacagatcttgtccgtacatataaaaaaccgatgtgagcgcaaagaaaacagagagtgacagcaccagatatttaaaggctttgttcagcctgaagaaatctttgacttcttttaagatgtcaccgaccgtctgcgtttcgtgttcactgttttcaaatttgatttccgtcagctgtgtaatgaccgccattgcaatcagctgagtcacaatccccgcgataaacacataagcccatgatatttcctgtaagtaaccgccgatgcccatggcgatcgcaagaccgagtatgacaagtccgttatagtttccgatggatttgccgtaccacttttccttcccttgttctttcagtgaatcaaacaaaaaggcgtgatccgttcctgatataaacgtcagcccgacgccgtatataatatgggcgatgaagagggcgatgaagttatgaaagctcaggaacatcgccaaatagacaatgaccataaaatggccgagcaagagcgatttttttctcccgattctgtccgagatgacgccgcttggcacttccgccagaaacatcgccaaattcaagaccgattgcaggatgcccacaagaaacaacgaataattcatacttgttaaatataaaatccaaatcccccgttcgaaaaaaaagtttccgaaaaaaccggagaagtaaagcaaatttctattccgcacatgaatacccctttccagctatctgcatttaacatcatgaacagaaaggagcccgtcagtcttaacacaaaaaccctctatacatggatcttgcagatacagacttttcccaaaacaaattgggcaataatgagttgtattctcgaataacccaaaaagttccttcttttttccagcacctctctgatgccgccttcatatagctcatgcacgtaagacggaagaataatcattgaaatggctgaaatcgggagatgataagtccgcttcggatcagttctggtttttccaagaggggcggatcttcctccggcttctatttcatcagacggctcgcccatggtaacgtcaaatcgttttttcctattatgttcacccccggctgatcgccttttacaaacggtaaagcatgttttatgtcagaaattgctgagctggggattttgattatttcggcacctatagtccgggtgaatctcaatactcttgtatgagcggcatctttgcgggtcagcagacttatcccggcagccggataatgaacacggagccttttccctgctcacttttcacttcaattgttccgttatggctgtcgataatggtttttgtaatggcaagacccagcccggtgccgccgtatttacgggatcgggaggtttccgccctgtaaaaccggtcaaacaaatgaggcacatgttcgggggcgatgcccgttccattgtcagcaatcatgagcatgatgccgccgtctttctgcagagaaacggtgatgacgcccgtttcttcatccgtatgctgcaccgcgttgtaaaagagattgagaatgacctgcttcattttgtccttgtcaaaaacggctttaatctgttgatcgacaaaaaactcgagcttccggtttctcgccagcagcttcagctgagcctccatttccaaaatgacggctcccagtgcgcctttttccatttcaaagctcggcactcggtcaatcttcgcaagaaacagaaggtcctctatcagcttattcgccctgacggattcggcgtacatgcttcggagcgctttttctttctgttccggcttctccgccgctccgcgcattaaaatttcgataaagccgtgaatggaagtaagcggtgttctcagttcatgtgacgcgtctgatacaaactgccggatgcgttcctttgcttctttttccgcctgaaaagaggtttcaatccgttccagcatctgattgatggatatgcctaatgactcaatttcggcctgctttttatcaatcggcagccgtttatcgagactgccggcattgatgtcacccatcatatgcacaatgcgcgataatggcttgagtgtgagccggatcaccggcaaaaaaacaaacagtccgatgaccaaagccgcaaaagaaagcaccgcaaaaataccgacctggcggaaaagcgaatcatccagaggctgtgtcagcgtgctcatttgcacaacgcccgcctgccttccgtcaatggaaatcgcctgaaatacgacgatgatttcctgacccatcttattgtgagccacctgatagtgaagcgccattgtgtctgtcagcgcatcccgatacacgtttttcgggaaagaaggagcggttcccgcgtgcgggtcctctgataaaacagacatcttgtatgattgatcgataaaagcaaccgtcaccccgggataaatcaaattcggatgagccggtgtttcagaacgggcaagggttttgattgacctccatacgctttgatccattgaattgatatagctctgaatgctgatcgcctgattttcatacatcgtccttttcataaacatgtactgcgtgccgccgatgaagcataacagcagggtcaaaatcgccagcgacctgaacaggagctggaatcgcagggttctgtacagccgcttcatgccagatccaccctgtaccccgcgccccgcaccgtgcggatcactttatgctctttgtctttcagcttttcgcgtaaagaacggatgtacacctcgacgatattgtcttccccgtaaaaatcatagccccatacttgatcgagaatcctcgttttactgagcaccgtcccgtggcgaagcactaaaaatttcagcagttcatattcggtggcagacagcttcaaaggctgttcattgtaatgaatctctctgctccggtcatcgattcggaaagggccgagcaccacctcatcaaaaagatgcggaaactggttgcggattcttgcgtaaatccgggcaagcagctcctcaaagctgaacggtttgatcatgtaatcatcagccccttcaatcagcacctttacgcggagctctacttcatccttcgcggtcagcataatgacggcggtattgcttgttttcttgagcattcttgacagctcaagcccatccattcccggcatcataacgtccaaaacagcaatatgaggctgaaatgttttaacaagattcattgccgacatcccgtctgccgcggacatcacttcaaatccttcattgacaagccccatcgttaaaaaatcaatgatcgccggctcatcgtctacaatcagcaccttgatgcctttcaacttatccatgatgcagtctctccttagatgtatcagcctgagtttatttttttcgcttccccctctattattcgcttttatctgaaacaaaactgaatctaagctgaaaatccgctgaattcaggaagttttcagcttgtcctcatattgttttcagcttgggtctttacaataagccttagttgggacgccaacgatgaaatgtttaaggaggaatatacgatgggaattacaaaagttttatcaggagctgcactggggaccattctttcaatcagttctttaacttcagcacatgcggctgtcattcataaggatagcgctgcgcaggcgaaagtggaaacgaaacaggaggcttccgtttccatagcaaaagcgaaagaagcagcattgaagaattgcagctgcaaaggcgccgttcaatcagcgcaaatgaaaaaaatcaacggcgcttacgtatatgtcgtcaacattcttgacgtaaaaggaatgcagcataccgtcaacgtcaactgtgacagcggaaaagtcgtgaaacaccagattgaaaaaaaacagcaattcatttcaaaaacgggtgctgaaaaaattgccttgaagaattgcaaaggcgccgtgaagtctgctgagctgaagtccgaaaataacgtcatggtttacgtcgttcaagtgtcaggacaagacggcaagcttcacacaatccatatcaactgcaaaaacagcaaaatcgtcaaacatgacataaaggataaccagcaatacatgacccgtacaaaagcggaatcattcgcactcagccattgcaaaggcgccgtgaaatccgctgaaatgaaaaaagaaaacggcgtatctgtatatgttgtcagcatattcggccaggacggcaagctgcatacgctccacatggacggcaaaagcggtaaagtcctgaaagaagacgtgcagaaaaaacaagtcatgatcgcttctgaaaaagcgcattccatcgcgctcagccactgcagcggaatagtgaaatcttctgaaatgaagaaagaaaacggcgtctacatgtacatcgtcaaaatcactgcccaaaatcatacggtacagacagttaaagtaaacgctgaaaacggaacaatctgcaaataacaaaaaaataagctgccggcagtttcatctgccgcttcaattttgcaacaccagtcgtttcaatcacaaaaggttctaagttcatgtctgccttttctaaatatacccattttcaactgaacgtgctgtgacccgcgttcagttcttttttgtgagctgctgaaaaatggcataaaaaaagcgccctggaaaaggacgtttgaggataggatttaaattctgcattctaatataattcttccttcacattcaccttcaatttcattcaatacaatgatcacatcagctgttttcatgttttttcacccccttttattcataatattaacaaataaatcaataaaaaacagcccggatttccgggctgcttttttatttctgcaatcgatccgcttctgtcagtttgacttccgctgtttttttctttcctgaacggtagaacgtgatcttgacacggtcgccgatctttttgcgatacagacgctcacggagatcgacaatgtcattgaccttatgtccgtcgaatccggtgatcacgtcgagctttttcaagcctgcttttccagccggtgaaaacgcgtcgacacccataatgaccgctccggttttaacacccttcggaagtttgagcgtctggctccaatggtagctcgcaatatccgttaaagatttcatctcaataccgaggaaaggccgtctgacttctccgtatttttctaaatcctgaataacgggaatgacaagctttgacgggatggacaggccgattccttcaacggcggattcagcaatcttcattgagttgatgccgaccaccttgcccgatatatccatcaaagcgccgccgctgttgccgggattaatcgcggcgtcggtctgcagcacttccgcattccaatcaggctgtccgtcgccgtttgagtcaacgggaaccgccctttccgttcctgaaatgatcccttgtgtcaccgatcccgcaaattcaagtccgagcgggtttccgatcgcaatgaccggctcgccaactttcacttgatcagaattgccgaattgggcgaccgatttgattttatcagtcttcaccttcaacacggcaagatccatcagacggtcgctcccgatcagctcggcaggcacgcgcgagtcatctttcaggctgatctcaatttcagtcgcaccttcaatgacatggtgattggttacgatataagaagtgtttccgttctttttgtaaatgacgccggacccgcttcccgcttcgccgccctctccccaaatatcggtcttttggatattgagaacgccgactaccgaatccgatacacggctgaccatattcgtgacagcatcattgatatttacgttgactgttttcacctgttcgctgccgatgcgctgattggcgcttttgctgctttctccatggtctccgcctgtccagtacggcagcagtaaacccatgagcgcggccccgacgatgacaccgatcagacttgaaaggaagtatcctctcttgctgcggcggggctgctcgggggcgtactgttcatcatcgcgattataatccaccctatctcaaatcctttcaagagaacttaatttgcttatagtgtgggttagatcgcggattaataatcatgattcatttggaaaaattacacggcgcacagaggcgtcgggattttcggatcggtatcaaataattgaaacgtttcccccgcgacaaatccttttgcagccaatgtctgctgcacggacattctcgccagttccttcatattgttgtcttggctcagatgcgccaagtagatgcgtgatgtgccgtcgccgatgacatcagtcatggcgagcgccgcgtcttcatttgagacgtggccgacatcgcttaaaatccgccgtttaatgctccatgggtatctgcccatttgcagcatgccgacgtcatggttgctttcaaacacaaacacattggccgaacggataatgcccttcattctgtcgctcacataaccggtgtccgtcatcagcgcgagctttctgccttggtagtggaaaacatagaacatcggctcggccgcgtcatgagagacgccgaatgactcaacatcaagcccgccgaaggatttcacgctttccatcgggaacaaaaacttttgtccggtgtccagcttgccgatctgattctccatcgctttccacgtcttttcattggcgtataccggaagaccgtactttctcgcaatgacgccgagccctttaatatggtcgctgtgctcatgagtgacaaagatgccgtccacgtcgtctatcttacggccgatttgctccatcagcccgtccatcgcttttccgctcaggccggcatccaccagaaaggagtgctcctctgtctccagataaaacgcgtttccggtactcccgctcgcaagcacgctaaattgcaagcccatttgtgtctcactccattatttattttgattgttatcaatgactgtgctttctaatgcattcacagtgtacgtctgctgtgtctttttcttaggcccttttgacttatcttcaattgtaattctccataccggcgccagcacctgcgtacttgtcagcgggtattgggcgatatagccgaacttgacgcttttgacggcgcaattcgcttttaagtaattttgagaatacaataattcgaccgcatccagctctggaatcaggctttccatctggattcgcttgaatgactccagcatggtctgctcgtaagatacgacctgatttttatcgttcagatgcagaatgacctgtccgatcgcgtcagaggacgagtcaaaatcctgataaataaactgtccgtcatacgtctggtaaaaaatgatctgttttttatccttatcgactttccacagtttatatttttctccgccggttattttggagctgacgagcgattccgcatcatcctgcggcttttgcttcgataaaccgaccggatcggaaaacttcattctcagcgtcgtgaccttgtgatcatccgtcggcatctccattaacggcttctgatccttcaaggcttcaatatcttccgcggtaaataccttttggcccgccgtcagcctgtagcccgtctcggaatcagaagacaggttcccgaatgtgatatgatccatctccatgtctttttccacatttgaatttttaatcacttcgtattcgctgcttgaacgtttttcaaaaaactgatagccgagaaaaatatcaaggatgaggaaggcaatgatgaagatcgtttttgtcttattccactccattatcgtcctcctccttccccagcagatctttcgtaatcggaacgattttcccgttgattttcatactccagacgggttccagctcaacaagatcattcgttgacgaagataccatttgataggacaggaagatctggtcgattttgttcacatcgtatttatcctgctgctccagcagcgacacaacctcactgccgctcatcatttttacgtcttttgttttaatcggattcggcccgagaacatagttcggccgcttatagctgagaacctcgtcattggcccattgcagggtcataacaggcccggctccgaaaggcttagacgtgctgttgatgacaggcatttgatctttaaacatgtagaaactcagctgctggttatcactcacattgaaaaattgataatgatccgtccagctccccgtatcctctaaatatttatagcttttcttaatcagctctcccgtttgataagaagcgctttgcgccaggttccggtgctggaattgaatctgccgctgcgtcgaattgatttccagacggctgattccgtcagtcagcacattccgattgtaattcggatcctctctgaccgtgctcggatcattaaagagcgtctgcttaaacagattcgtcttaatggtttcagtaataaattctttttccttcatattaaaccgcgaattcggcatgagaaattctttgctttttccgaccgaatagaggtggtataacggcatactcgattttttgctgtacagctcattcatcaggttgcggtaattcgccgattccacagtcacttccagaatcagctgtttgctgtatgagaccatgtaaatcttcttattcgctttattctcattaaacggaatgacaatatggtcaaatgagctgtattccattgactgattcgaccatttaaacatcgattggaagaaatcaatcggaatggtgtcattgaattgcagatcgagctttgccgaatttccgtttctgccgtaaagccaatttttaaaaccgagcttgtcgtattgatcggaaatatctttcatcccttttacttcccattgcggcaaatccgcccacaggtcattaaagagcgtctcatcatccactttgtaatgagagccgtttgtatgaataaacatatcccggggttttaccgtttgcgacaatttttggctcgttttatcaattttatgcttttcccggacagtcgatttggttgaggccgtgccttctgaaaaattgggctggaacgtccaaattccccatgttaaaacaagactaatgacgactagcaccgacagtatgactgtttttatattttcacgcctcatcccaatcatcctcttgctcttctttatatggaagagtaaatgtaatcttcgttcctttgccttctacactgtcggcccaaatgtcaccgccgtgcgcctgaaccatctcttttgcaatcgcaaggccgagcccggtgccgccgagttttctcgtgcgcgctttatccactctgtagaaacggtcaaagactttttccacatcttttttcggaatgccgataccttcatcttttacactgatgtagagcagctcttctttctcattcacatcgactgagaaggtgacatgtccgccttccggtgagtacttcaatgcgttagaaatgatattatcgagaacctgcgtcactttatcctgatcaatctccacgtacagatttctgtccggcagctcgcggataaattcgacatgctgttcctttgtcatttcaaaacggtcaataatcagagacataaagcggatcatatgaatccactctcgattaaactgataatctttgctgtcgaatttagaaagctgaagcagatcattcaccaatctgatcatgcgctcagtttcattttgggtcaccattaagaaacgcggagcgatctctttattttcccacgcgccctctgcaagcgcctctaaatagcttcgcattgtcgtcagcggtgttctcagctcatgagacacattggcaacaaattctctgcgctcccgatcgagtttttcctgttcggtgacatcataaagaaccgcgattaaaccatcaatttttccgtgctctctctgaataacggaaaaattcacccgcagtacagtcgtttcatcgtcacgatcgatctccagcagcatggaatcctgctgttctactaaatcctcaaaagtaaagttctcttttatgcccaataaagatgtaatcggcatctctaaagccgtttcacgtgaaacattcaacagctcaagcgcagggctgtttaaaagaataatagctccgttgcgattcgtagcgatgactccgtccgtcatatacgcgataacagaagaaagcttccttctctccccttccgtcatggcttgggcatcttcaagctctctcgtcagatggttgaaggtcgttgcgagctgaccgatttcatcatgcccgtattttcgaacctttctggagaaattcccttttgccagttccatcgcctgcttacgcatatccgagagcggatgggtaatggtccgggcgagaaatataccgagaagagccgtcagaacaagggctaagcccgttccggaagcaagaatcgagttgacggttttcatctggttaaaggtatcttccatactggccaccacataaatcgcgccgacaacttcctgattctccgtgacgaccggttttgccgaaatcagcactctgtttttacttttaggatcataatatttttttgaataggcctgttttgtagagaaaatccgtttgaaaatcgggtcagtcgtctgtttccccgctatttcctcgccataaggcctcgaagaaccgatgacctcatagcttttatcaacaaaagtaatttcccgtatttcattatttttcgtaaaatcattcaaaatacgtttgacgtcatccttaatgacggtgctgtcattgtcccctttatattcctgttcaatataataggaaaggttgtcaatccgctgatttaacgatagttcataggacttgaggagagaattctccacctgtttcacaaagtacacgccgataatctgcatggcaatgatgatgagaagcacatagatcagcgtaatcttaaactgaatcgaccgaaaaaaaccaaccttattcatcgccggttagtcctgttcagggtttctcaagtaataaccgacgccccgtcttgtgacgatccaattcggatggctcggattatcctcgattttctcacggaggcggcgcactgttacatccaccgttctcacgtcaccgaaatagtcatagccccacaccgtctgcagcaaatgctcacgcgtcatgacctgtccgatatgtttggccaagtaatgcagcaattcaaattcacgatgggtcagctcgatcgtttcttctctttttgatacgacatatgcgtcagggaaaatgacgagagacccgatatgaatgtcatttgaagctgattcttcctcagccggcgcaaccgtaagctggcggcgcagattcgctttgacgcgggccagaagctcacgcgtgctgaaaggcttagtgacatagtcatccgctccgatttcaagcccgatgaccttgtcaatctcagagtctttagccgtcagcataataatcggcatatcatattttttccggacttcccggcacacttcaactccgtctttattcggaagcataatatctaatagaattaaatcaggctgaagctcctccaccatttccacggcttcatttccgtcgtacgcacagtgcacgtcatagccttcttttcttaaattaaactctaatatatctgcaatcggtttttcatcatcgactacaaggattttcttatccatcatcttgattttcctcctgccagaatgacttcattttatctattgatgttttatgataatcacaattcggaacgtgaaaaacgttccccgtctattataacggtttcaggtcaaaagataaaaaaattaaagagaacagcgcaaaaacgtattgaactgccatccttttgtcatgttttttattttcttttaaaaaataatatttttttgaaacctcacgaaaaaaatcgccgtctactgtttgacgtcttcttctgggccggctgaaaagccggctctcccttttttgataacaaagaaaaaaacgcacctactattgcagatgcgtttgggtaagtggctcgggacggaatcgaaccgccgacacacggattttcagtccgttgctctaccaactgagctaccgagccagatgtttcttttctatactataaagtaaagtaaaatggcggtccggacgggactcgaacccgcgacctcctgcgtgacaggcaggcattctaaccaactgaactaccggaccttacagtaatttgtccggagaaccgtatcgtggcggctctccgaggacaaataaggagttagcaataacgctaaagtaaatcaatgacccgtacgggattcgaacccgtgttaccgccgtgaaagggcggtgtcttaaccgcttgaccaacgggccataaaaagtggtgagccatgaaggactcgaaccttcgaccctctgattaaaagtcagatgctctaccaactgagctaatggctcttgatgtgtcggattatgtatcatagagcattcagacaaaagctttcttgcagtactctattgaagctgttccgtaacaacgagatttataatatcatagaacattcgaaagtggcaactacttttttgaaaaaaatctattatttttttcccacatacaaaaacaagcctccggtcacggaggcttgtctgctgcaaatccttagttagcgcggtatacactgcggatgacgttcgtttgtgaacggtcaggaccgacagagaaaatagaaagcggaatacctgtcagctgagacacgcgttccagatagtggcgcgcattttcaggaagatcgcttaatgtttttgcgcctgtgatatcttccgtccagccaggcatttcttcatacaccggttcacactctgcaagagctttcagacttgccgggaattcttcaatcacttcacctttgtagcggtaagcgacacagattttcaaggtctcaatgcctgtcagcacatcgattgagttcagagaaagatctgtgattccgctgacgcggcgggcatggcggacaacaacgctgtcaaaccagccgacacggcgcgggcggcctgtcgttgtgccgtattcgcgtccgacttcacggatttgatctccgatttcatctttcagctcagtcgggaaaggaccgtcaccgacacgggttgtgtacgctttagatacaccgacgacgtgctggatttttgtcgggcctacgcctgaaccgatcgtcacccctccggcgaccgggttggatgaagtaacaaacgggtatgttccttggtcgatatcaagcatgaccccttgagcgccttcaaataagacacggcggccttcatccagcgcgtcattcaggacgacggatgtatcgcatacatactttttaatctgctggccgtattcataatactcatccagaatatcttcaattttgaagccttccgtttcatacattttttcaagcagacggtttttctcttctaggttccgttcaagcttttctacaaacacgtctcgatctaacaggtctgcgatccggatgccgatccgtgccgctttgtccatataagcaggtccgattccttttttcgttgtgccgatcttgttggcccctttgcgttcttcctctacttcatccagtttcagatggtacgggagaatcacatgagctctgttgctgattttcaagttatccgtgctcacattgcgttcatgaagatacgcaagctccgttacgagcgctttcggatcaacaaccattccgttcccgatgacacacgctttttctttataaaaaattcctgacgggattaaatgaagcttgtacgtgactccatcaaacttgatggtatgtcctgcattgtttccgccttgataacgtgcgatcacttctgcattttctgacaggaaatctgtaattttaccttttccttcatcgccccactgcgtacctactacgactactgaagacatatatccgtgcacctccgttaacctttcaaaacgatatctcattcaaacaaattaagtgtatcagtgccgatgcagaaagtcaatcgtaaatccgaacattaaaatcttatcattctatatttgttcgccttaatctcaattaaaagcgttttctctttcatttgttatctattactcacgaaactttcacgctttaataagaaaaagaacccataatccgggttcttcggacagccgcttatattccgcttgtattcatcaggacgatccgccagccgtcaggatcttcgatggtcacgcctttttcaccccaatacgggttttcgggttctttttcttcatatcccatttgctttaatttcgtgctgatgcggatgacctcctgctgatccgggatgtagaagacaagctggctgtcgccgtgcggaacgggcgccggctgagatgcgccggtttcttcagtgaattctaagtgatattgggtatggggcaggccgaacatgacgccgctgtagccctcatggccggaaaagctgccgacccttttcagtccgaggccttcttcataaaacctgatgatttctttgagctgtccggtcggccgggcgatccggatttgcgccgcttgaaattgcggaaattcaattgtcatcatcattccccccttgatgccattatataaaagcgctttccttttttcgtctgccgaacggttgtcattctctcgttctttcggatgaaaaaaagcctcaagacatcgcttgaggctttacgcacctgccggaacaccgccgtcatcaaagcgcctttccaggtttacgaacttattgtattctttcacaaaagccaatgaaacggttcccaccgggccgttacgctgtttggcaataatgatttcgatgatgtttttgttttcggattctttatcatagtaatcatcacgatacaggaaggcgacgatgtcggcatcctgctcaatacttcctgactcacggatatctgacatcatcggacgtttatcctgccgctgctcaacaccccgggagagctgagacagagcaatgaccggaacttcaagctcccgtgccagcgcttttagcgcccgtgaaatttccgatacctcttgctggcggttgtcgcttgaacggccgcttccttgaatgagctgtaagtagtcaattaaaatcatgcccaagccgttctcctgcttcagcctgcggcattttgaacggatttcgctgacacggatgccgggggtgtcatctataaagataccgctgtttgacaggcttcccatcgccatcgtcagcttaccccaatcctcttccgtcagatttcccgttctgagattttgggcgttaatattcccttcggcgcagagcatacgcatgacaagctgctcggcacccatctcgagactgaatatcgcgacgctctcatccgttttggtggccacgttttgcgcaatatttaaggcaaacgccgttttccccacggacggacgggctgcgacaatgatcaaatcattccgctgaaagcccgccgtcatccggtcaagctcgataaaaccagtcggaatcccggtaatatcgcctttccggttgtgaagctgctcaatgttgtcatatgtttgcacgagcacgtctttaatattttggaaggcgcccgaattctttcgctgcgcgacctccataatcgttttttccgcatcgcttaataaatcttcaacttcatcctcgcgtgtatacccgtcttgggcgatcgtggtcgccgttctgattaaacggcggagaatcgatttttcctcaacgattttcgcgtaatattctatattagccgctgtcggaacggaattcgcgatgtctgtcagatacgagacgcctcccacctcttctaacaggtcggtattcgcaagctctgacgttaccgtgatcaaatcaaccggttcgccgcgatctccgagcacgagcatggcattataaattttttgatgtgacattctgtagaaatcatccggaatcaacacttcagaagccagtgtcaacgcagacggctgtaaaaaaacagcacctaacacggcctgctcagcttctatgttttgcggcggcagccgatcattcagaaggtctgtcatgctaagcaccgtcctctccttaaaaaatatccaaactccattttaccatttctcatgaaaaagaatagaaaaatatcgctttccctgtatttgtcagactatggatatgtgtttcaccgttccgaatgctgggaaacatataaataaatcgataccaggagggaaaaaagatgaaaacatatgcggtaacaccaagtgttgatgcggacggatggtttgtgaaggtggaaaatgtggcgccgacggctctttatacctcaaaggacgcggcgattgaaaaggcggagcagacggctaaagagaacagcccggctaagcttgtcatttatgatcagcacaaaaacattgaagaagaacgaaccttttgagaaaagccttcgcccgtgcgagggcttttctcattcaatgaagcgaatacgcagcaccgtctgcgccatgagatcggccgttttttgatacagatcccattcttcacaggcggcaaatactttcatcatttcctgcaaggtctgtttcagcaagataaattcgtcaattgtccgcagttctgcggcttttttctgataatcagccagcttcagctgtaataacattaatggcgattgcataaaaaacctcccccattctgttataacgcccggcttttcaaacctccatttctttgtcatatcctcttacgatcgatttttgattttagtacaataaagaaacggaaggagtgataacatgaaaccgctgcaaatttccgccgaaacggcacaaaagcttgcagaatcactgaacatgccgcttgagagaatcatgcacatgcctcagcacattctgcttgccaaattagctgaagtccaaaaagagaacgatcacaaataaaggctgctctctcatatatatgtgcgggaggcggaagcgatggctttccgcctctttttttatggagaaaattccggtgagacattcgttatcgtttattcatatacgctgagggaaaagtgaagtgcttcttattatccggaaacaattcaggcaaaagcttgtctcttcgattaaaaagaacggtaccaaaaatctcagctgaccaatactgcagcaccggaaaagaggccggatatcgaacgccggccttttatctgctcttgaaacacctgtcatgcctgcgcctataatatggaaccttttataaaaatgattgataaatactgtctatttttgaaaccatgatgtcctgacgcagatgctgactggcataagattttgcttcttttccgagccgttctctgagagactgatccgtaatcaatgacacgagggcagcagcaagctcgcggctattgccgggctgacagataagccctgttttctcatgccggatcatttcaggaattcctccgcattcagaggtgataatggctttaccggaaaacatagcttcgatgaccgctatggggaaattatcattcaatgtgggcagcacaaaaatagacgattcagccaaaagatccggcacatcacgtcgttttccgaggaagaacacatttgaaagacccaatttccgtctcttctcttccagaaacccccgcattttcccgtctccgattatccaaatttcggctcccgataaatgctgccgaatttgcgcgagggcatccagcagcacaccatgcccttttcgctcggtcagacgtgaaacacacacaatcacgagcttttcagtacgtttcggcttgggtgcatcctggacgtgaatgccggtataaacagtcgtcagctgtgtttccttcgcgccgtactccagtaaaggcgcgtgaaaggagtcactgatggtaatgattttatccgaagcccgaatgccctgtttttctatttcagtgaagtatgcctcttcaattgaacccttttggattttatgaaacttcatccggcttttcgtaaaatgtccgtgaggcgtgaagaaaagaggacgccgatatgttcgattaaggtatcccagcaaaaataccgcaaataaatcctgcgcgtgaaacagatcatattgttctaaatctttttccttcaaaaatctttgaaagacatgtaaatagctgagattcttcacaagcttttcgtttgcggcgccgtatctgccgagaagaaacgctctgacttcatcagcggcccgcgggatatcttcctgaaaaaatgaaggcggcatttggagcggcgagatgacatccgcatgatgaccgatgcgctcaaaacctgtcttaacggacgtgatataactcgccaatcctccgacattcgggtaacggagaaaggttgcgtacaaaatgcgcaatggcttctttcttttgggggagctttttccttccgaacaaaatgaacgcagcatcccttgctcactttgaggttcgattccgtaaaattgatccatgacgcgcaacaaggcaagaggcaccatctcttctctcaaatccgctcccccctctcaaacctataaacctaattcccgcccccattgtgacactttgtctacatgatacgggagcagctctcctccccgattgtcgaagattctccgcaattgggtatgaagccctttctcaggtgtcctctgcaaataagacattttataaagcgtcataggtggggtctgaaaatgaatgccccgctttttcatttctttcgtatacacttttacgcaatacgtccgaatgtcttccgcgtgcgggctccaatcttttctgaagccaagcagaatttcaaccagcaccgtcatatcaaaccaaaccggcgcgtattttgctgattcccaatcgatgaattgaatatcccacggttcatggccggacgcatcgtgggtgcaaatattctgcatatgaaggtcgccatgtgtaatggctgagccgttttgcatcaattcagggaaaaaatccggcccttttcgctccagcaggtttgcgatttgccggtaatgaggctttacgatatcctttgttcgatcatctttgagggcccgatccagtaattccgctgtctttttgatctgctttttacgccccttcctcatggtttccgattcatataccggcagccatgaccgccatttcccgtcagaaattttcttgttttcaaaggtgcggctgtgcagttcagcaacagacggaataatataccgaaaatgcttaggatgaaatgtaagctgtcccctgatctggctgacaaactccataaatatccacgtttcccggccgttttcttctataagatatatgtccggcatcaaatcccctaagacggcacgggctttactgtacatattaatctcggccttgtttttgtcacgggaggatttatacaccttcaaaatcagcgggacggtgccggatttctttttcacaagcagtttataaatggcgcttctgtctgttgttttcaggcatgtgatgtcatccgggttcacagccgccttttcgccaaatgaatgcgacagtttttcgtcaattctcagtttctgaaatgcttcatacaaaatatccttttcagacatgctgatcttccttccgcttccgtttccagctgtttttgagatgggaccaagtgtttctgataaacggcattgggtcattccaagcaaaaagagcatactccttttttcctttacaccctttccaaaaatcccggaacgtcatttctcctctttttcgtttcttcaaaaacgttaagaagtaacgcacttcataaatccaattgattccctctttttgctcgagctgaggcttcacatgctgtccggtcaaatacagatagtacatgtaaacaaaatgaacgcctgccggttctgtcagactatggctgagccaaaagcgcggattaatttctatgaatttgtaaacattgtcccgggggtcctttttaaattccgccatgcctactcctttcagctgaatcgcttcaaaaaacggcagggtcttctcaattaattcaggaatccgtttgctcacgacatgagcccccgcgccaaaatcagcagggaattgatggtttttttgcagagaaaataagcccattaatttcatttggtcatcataaaaagtggcgactttataaaaacactgattgtctccgggaatgatttcctgcacgagcagttttccattttctctgtaggagctgaactccttgcgcaattgtgtctcatccttcatcacaattgctttcttgtttacttttttcctgtattcatggccggacaccggttttaaaatacacggaaactcaatattggcgatggcctcttccaattcatcctgattgttcggaaaaaaggttttcgggcaggggatgttatgcttcaccgccagttcatatgctttgcttttatctaaaaccgtttctaacagagagtggctcgggagcaaaaataaaaaaaaaccggctaatgttttgcggaatttagatataaatcccgcataatcatcagatcctgcgtacagaaccggttttgcttgaaatcgcttcccgaaatcagtcagaaatgtcagaagttcttcctcttgtgttaaaggactgggacatatcccgcaatctgctaatcttgattttccgatacgataaggtccctccgtgtcaaacgcgtaaacatctattcctcttcgggccaggcttcgaatcatcccgatcccgtttgcactgaaatcaagtacaacggccgcatgttcatgtttcatgatttccctccgagcttgatggtattttgataaatggattcgatattttttatcatcgtctcactgcttaaatatttctctgcgtaggcctttgcatttaaagcagctctctgccgcgcaggtttgttagagataaaaaacgctaatgcccgggcaagatcctttgcattgcccggttcgacaataagccccgttttgttatgacggatcagatccgggatgcctccgcaatcggtcgcgatgatagccgagccgctgaacatcgcttcaataatagaaatgggcagactatcattaatggtcggcagtacgaatatgtccgtctcttccaaaatagcggcaacatcatctctttttcctaaaaaggagaccattgatagtttcagttttcgagcctgttcctccagagcgctccttctctctccgtcgcccacgatcagcacttctacatgatcaagtacatcagacggaattcgagaaagtgcgtcaagcaaatgattatgcccttttctcgggcctaatctcgcaatacatgagatgatgattttatttttcggtaacggcgttttctttttcaagcctgtttttgcatcgtaatcgattcctgtgaccaccgttgtcatgtcttcctgtacggctccaagcttcatcagcgggctgcgaaacgtatcgcttataataatcaggcgatctgcgtattcaatggctttcatctctagttttttgtaataagcctcttctaccgagccttttttaaatatgtgaaacttaagtctgttgaaagtaaacatgccatgcggtgtaaacaataaaggttttttatagatacgattgaatctgcctaatatattggctgtaaataaatcctgagcatgaaacacatcatattttcccagattcatcttttgaagcatttgctcatatatgaacatcagccgattatttctcaaaatatgatcgttataatccccgtatctgtctctaaagaaatcttttaataacggaacaacagcggtccgcagtttttttacttttgcggaaggaaactgattgggggatatgacatccaccttatggcctctctttttcagtccctcactaagtgttttaatatagttggataaaccgccggtgtgcgggtagtcccaaaatgtggcaatcagaatggataatttcttttttttcctgtatactcgcggaatacgatgtgactgtttcatctgggtcttgattgctgtctttttttgcgggcgtgttttgaccccgtagtactgatcaagcgtctggaccatatatggatatgggatggtaaacatctcgttcatttccagatcctccgcacgacttcaaatgcctcggcgtattctacgcctgctgtcatccctctgactcttcctaaatgtttaacaccttcatatgaacggggatgaggaaaatccctcatttctacgtcatagtggtgaagcgccgcaagtttggcgtccatcgtctctgtgatatcaacgaagtaattgggcttgaagagtttatcggccgtattcctctcccactcgcttgaagacagcgtttcaaacgtaagcagttcaataggcttttgattcggaagaggtctggcggctgtcaaaactgcttggaatgttctctggtgatccatattgatatcaccgtaatgatgagtaaagattttatcaggctgatagacgcgaatgagctgttctaattctttgacaagcttatgaagagggatacattcaagttctaaattcgtatgctctaaaaagatgactttctcaattccgagctcttgattcgcctgttcgcctaattgcttaatatgatgcgcttcttcttttctgcctaatgccgtaataatggaaatcactttatatccttcattgatcagccgttttatggtgcctgctgaccccaatagttcatcatcaggatgagcaccgatgaccataatgtattcttccattttttccacactccaccaaacaaatgttacaaatatcatatgacgaccccaaaaaaaggaaacttacatgtgcggattttcagaaacttgcatgtgcagctgccattccaggtaacgtgacggatctaattttttcacagtgttcaaaaactcagccgccaagccgtatttttccaacccttttaacagttttacgggcactcgggcatcggaggaaaaggctcttttatggtcgatgactttaagttcaccgtgttcgttgatcaaaatgtgcctgatttcggcatcccatctggtaaaaccgagatcctttaattcatccagcatatttaaaacagcggctgtcagttctgcggatagagatttttctgttttgatatggctggcaagggaggtgccttggacatattccatcacaatataatgatctccgtattcatgcagccttggaatcaccggtgaaacttgtccgatctgaaaagcggccaattccttcttgcatgtctcttcttcaaaaaaatattttatgcattggttaggtgttaagaggtagacttccccgtcttttcccttgccgatcagcggatagtcctccagcacctttttattctcagggttttgaaagaagttttcagaaaaaaatcgcttcataccgacacatccttcgttatgatgtaatataatatgcaatttgataaccttcggaaatgaaacattcttatcattttcttgcgatgcgcctctgaagacataaaaaaacccgccggatcggcgggtttttcatttgatattacgcttcttcttttacgtgaaccttcagcacggcctgaacctcaggatgcagctttacaggcacatttgtatatcccagtgtacggataccgtcttggagctccagtttccgtttatccactttaattttatgcgttttttgcagcgcttctgcaatctgtttgcttgtgacagatccgaataggcggccgccttcaccggatttggcactcagctcaacagtcagctgttcaagcgtttcttttaagtccttcgctctttcaagctcagcaatcgcttcttttttctctttttctttctgtcctttcaatacgctcatgtttgtcgcatttgcttcgacagcgaggccttttttaatgagaaagttatgtgcataaccgtctgctacgtttttcatttcccctttttttcctttaccttttacatcttgtaagaaaataaccttcatctctgaacgcctccctcaaaatattcatcaatggcttccttcagccggacaagcgcttcggaaacagaaatgcccgataactgggtcgccgcattggttaaatgccctccgccgtccagcgcctccataataatctgcacattgacctcgccaagcgatctcgcactgatgcacaccgtatgttcatcccgtctggctacggcaaatgaagcttccacttcactcatcgataagagggaatcggccgcctgcgcaatcagcacctggtcaaagtactcctcttcattctcaggaagagaagcaatcgcgatattttctttatatagagatgtatgctggatcagcttcgcccgcttgatataagaaccgaccgattctttgaggactttctgcaccagaaccgtatctgcgcctttcgctctcaaataagaagcggcgtcgaacgtccgcgagcccgtgcgaagggaaaagctcttcgtatccactattataccagctaacaaggccgtcgcttcaatcatattgattttgagccgcttcggctggtactcaagcagctccgtcacgagttccgcggtggatgaagcgtatggctccatataaacgagcagcggatctttaataaattcctcgcctcttcggtggtggtcaatcacaacgatgtgctcgattttgttcacgagacgctcttccatcacaaaggacggtttatgtgtatccaccacgacaagcagcgtgtcatcatttgaaatttccatcgcttcttccggcgtgataaaccgcgaccacagctcttcgtattttttaatttcttcaatcaggcgctgaacacttgatccgatctggttcggatcaatgacgatgtagccttccttgccgttggcctgcgccaccttcaatattccgattgcggctccgactgcgtccatgtcaggaaacttatgccccatgataatgacattgctgctttctgagacaatttccttgagcgcgtgggaaatcacccgggcacgcacccttgtgcgcttctccatcggattcgttttgccgccgtaaaatttcaccttgccgttcggcattttgatcgccacttggtcgcctccgcggccaagagccaaatcgagactggactgcgccagatctccaagctccttcaaggaagaaaccgatgcgccgatgccgatgctgagggtcaaagatacagtgtgaacggatgttttttcacggatttcatccaaaatcgaaaacttcgcgttttcaagctccgttaatatgtgttcatttaacactgcgataaaccgctccgaggacgtccgcttcaggaaaatgccgtactcctgcgcccatgcatttaataatgaggtgacctggctgttcatcgtgcttctcgtttggtcatccagcccctgtgtgacatcatcgtaattatctaaaaagacatatgccagcacggttctctcattttcgtactgcttttcaatctgaatctgttctgtcacatcaaagaaataaagcaagcgctcatctcttttaatcaccactttaaatttccgctcattcaaggtgatcgtttccgaatcgacctcctgcttgatcagcggcacgacggcctcacatgtgtcatacagcgagcgcccgacgagcgtgctttcattaaagcaggaagacaaaaacggattcgcccactcaatgtaatattgatcattaaacagcataatcccgataggcatttccattaatgcctcttcgcctacttttttcaatctatacgataacgtggagatataatcgtcaatttctcttctgatcagagaatccgcacgcttaatgaaaaacaagatcacggcgagcagcacaacgccgacggctcctatcacccagttaaagtagatgctgatgaggattatgatgattgataatgcaatcaatgcatagatgggataccgaaacaacggtttttcataaaaactaggcatttctatcaactccccacctgtaagtcacactcaatttcgcgtcaccttatttcttatgttaaagcctatgtcaatgatgcctaagaggagatacacggacaggatgaacggaaaaagcacacccagcacaatcgctaatacaggaacggcttttggcatctccatctcatgacagtagaaaaaaataaacgctaatccttgaatacaaatcagcaagctgagaataaatcccccattcaatgaaaccgaatacagcatatgccctttttccaaatgcagaaaccctaatatcgtcacaataaagtacagaatgacaacgctttgcgggagtttgagctctctaaaaggcttcatcttcggaagatcggggtagaatcgccttaaaagcggccttgccatcgcataactgatgaaagcaaaaacaacaccgatcaatacgagcgcggccggaaaaagatattgaagcgtgctcagctgattttccatcagtttcatctgcttcccgaactgatctccgtaacccagctgctttgacatggcatctgccacagacagcgactcccgaagctgggacatggtgttatcaaccacattcatattaagaaacacgatgctgactacaaaaaaaacgacgccgcacagcacatacgccaaagcgccggatgcaaccgcataaccgggctgtttctttttaaagtaatatcccatagcgattcccgtacagaccgccgtaaaagcgcctgtaagcccggcaaacgaactcacaataaaactgacaggaaggctggcaagacccatccatacccccggcttcagaccgtgccgaatggtgtaaagaatgatcggcagcggcaaagcaaagagaagaatcgcccccagtaaagggaggtacacgaccaaaagggaaatgattgcaaaaatactgatcaaaatggcgccttctattagagcccttgtatttttcacttactcacctcaaaccttgtatcattctgaacatacgaatagaaaagagcagcttagacgactgctcttttgacgccgcaatgtctcattcaagacctgaattttccataaactctccaaaatacacgtatatattttaacataagtcaaaatcgtaagtaaaatgagcgcgggcagacgcaatgttccatgtgaaacattgaaacagataaacggacatccccgtgaaagaatgcccgttgtatcagtgatcctgatcatccatgaaaccagaagtatctctgtttttctttttggtttttcgtacatataacaagacgataacgataagtaagagagtggttgcctgtaaaacaccgctgctgaaaaggaagaagttctttatcatgtcccacatatagtttcacctctgtttcgtatttcctttacattgattttccctttctggaaacttcaaaacatcaggaacaacatcggaaccggggcatatgctgatagtgaaaatgaaggataaaggagattcttacaacatgactgagcggagaacattagcatggcatgaaacgttagaattgcacgagttagtcgctttccaggcaaacggacttgtgaaattaaaaagaacagaacgggaagtcagcgatgccagactaaaacagctttacagattttccatccattcgctggaacaaaatctgcgtgagctgcttcctttcttccctgaagcacccggctttcgtgaagatgaaacagaagagcgcgctgattcctccttttacagcggcggcctgctgagcatggccaaaacgtccgtgcgcaattacgccggagccattacagagacggccacacctcaattaaggaccgtcttcgtcaagcacttaaacgcggccatcaagtggcaccaaatggtctttgagtatatggaagaacacggtcattatccggctcataacctgagtgaattactgaaaaacgacgtccgcaacgccagaaaggccatcgcgatgaaataaaaaaaagcagcaaggaatgtcatcctttgctgcttcttatttttgaacggactgatctcgaggagacgttttttcccggtatgtctcaagaaactcccggttggcatctccccattccttcatctgcagcacgatcggttcaagcgacctgccgaattcggtcagtgaatactccacctttggaggcacctgctgatacacctcgcgatgcacgatgccatccgcctcaagctcacgaagctgaagcgtcagcatacgctgcgtaatgctgggacaaatgcgccgaaattcattaaaccgcttttttccgccgatcatatgataaaacaaaatgcccttccactttccgccgataacggaaagcgtcagctcaaccggacaaccttctttattcggatatacgttcatttttcatcctccatagtaccttttttgatactatatgctgattagcatctgacttacccagtattttactcgcaatcatctctccctctcaacaaaaatgcttctttttcacatcaatttttaaggttttgaagattacaccctccgcaagacgtgttaaactataaaaagattgtttacactacaaaaaaggacaaggagttattatggaaaaaattcttattttcggacatcaaaacccagacacagataccatttgctctgccattgcctacgctgatctaaaaaataaactcggcttcaacgctgagcctgtccgcctcggacaagttaacggcgaaacacaatacgcgcttgattatttcaagcaggaaagcccgcgtttcgtggaaacagccgcaaacgaagtaaacggcgtcatccttgttgaccacaatgaacgccagcaaagcattaaggatatcgaagacgttcaggttcttgaagtaatcgatcaccaccgtatcgctaacttcgaaacagcggaacctctttactaccgtgctgagccagtcggctgtacggctacaatcttaaacaaaatgtacaaagaaaataacgtgaaaatcgagaaagaaattgcgggcctcatgctgtcagcaattatttctgactctctgttatttaaatctccgacttgcacagagcaagatatcgcggcggcaaaagagcttgctgaaattgccggcgtagatgcggaagagtacggcttaaacatgctgaaagcaggcgcggacttaagcaagaaaactgtggaagagctgatttctcttgatgcgaaagagttcacactcggcagcaaaaaagtcgaaatcgcccaagttaacacagttgatattgaagatgtcaaaaagcgtcagccggaattagaagcggctctttcaaaagtaattgctgagaaaaaccttgatctgttccttcttgtaattacggacattttggaaaacgattctctagcgcttgccatcggtgatcaagcgccaaaagtggagaaagcgttcgacgtcacgttagaaaacaacacggctcttttgagaggcgttgtatccagaaagaaacaagtcgttcctgttttaacagatgcgattgcagaataaccaaaacaccccggacacctgccggggtgtttttttatagcatcgcgattttgtaagcgcatactctgacaaatcactttgacgcattttgatatgtggtatataatatatcacacacaaagcgcactttttctaattattgtaaatcagcgcaacaacaacagaatcgggggtttatacgctggaaaaacacgcttctctttcttattcacgaacaacaggaatttggcttgtgcttacaggtgctatcttatggggtgtctcagggacggttgcccagtatctgtttcagcaccgccattttaatacagaatggctgacttcagtgcgcctgcttctgtcaggcgtacttctgctcgggattgcgtaccgaaaagaaaaagggcgcatatgggccgtttggaaagacaagcaggacagaattcctcttctcttattcgggattttcggaatgttaggcgttcaatacacctattttgcggcaattgagtacggcaacgcggccaccgctaccgttctccaatatttagggccggccattattacttgctttttagcgatccgcgcaaagagaattccttcaggaaaagaactgatggccgtcttattagcggttgcaggcacatttattttggtcacacacgggaatgtcggcagcctgtctatatccggtctggctgttttttggggcatcagctcggcatttgcgctggcgttttacaccctccagccgcatcggcttttgaagaaatggggctccgccattattgtcggatggggcatgctgatcggcggagccgttctcagcctgattcagccgccttggaagtttgaaggccaatggtcgttgtccgcatatgccgcgatcttgtttatcatcattttcggaacgctcatcgctttttattgctatttggaaagcctgaaatatctgagtgcctctgaaaccagcctcctcgcctgtgcagagccgctgtcagcagcttttttagcggtgatctggctgcatgttcccttcggaatatcagaatggctgggtactttactgattttagccaccatcgctttattatctatcaagaaaaaataacctctcttttttagagaggtttttccctaggcctgaagcaccctttagtctcaattacccataaattaaaaggccttttttcgttttactatcattcaaaagaggaaaatagaccagttgtcaatagaatcagagtctaatagaatgaggtcgaaaagtaaatcacgcaggattgttactgataaagcaggcaagacctaaaatgtgttaagggcaaagtgtattctttggcgtcatcccttacatattttgggtctttttttctgtaacaaacctgccatccatgaattcgggaggatcgaaacggcagatcgcaaaaaacagtacatacagaaggagacatgaacatgaacatcaaaaaaattgtaaaacaagccacagttctgacttttacgactgcacttctggcaggaggagcgactcaagccttcgcgaaagaaaataaccaaaaagcatacaaagaaacgtacggcgtctctcatattacacgccatgatatgctgcagatccctaaacagcagcaaagcgaaaaataccaagtgcctcaattcgatcaatcaacgattaaaaatattgagtctgcaaaaggacttgatgtgtgggacagctggccgctgcaaaacgctgacggaacagtagctgaatacaacggctatcacgtcgtgtttgctcttgcgggaagcccgaaagacgctgatgacacatcaatctacatgttttatcaaaaagtcggcgacaactcaatcgacagctggaaaaacgcgggccgtgtctttaaagacagcgataagttcgacgccaacgatgaaattctgaaagatcagacacaagaatggtccggttctgccacccttacatctgacggtaaaatccgtttattctacactgacttttccggtaaacattacggcaaacaaagcctgacaacagcgcaggtaaatgtgtcaaaatctgatgacacgctcaagatcaacggagtggaagatcataaaacgatttttgacggagacggaaaaacatatcagaacgttcagcagtttatcgatgaaggcaattatacatccggcgacaaccatacgctgagagaccctcactatgtcgaggacaaaggccataaataccttgtattcgaagccaacacgggaacagaaaacggataccaaggcgaagaatctttatttaacaaagcgtactacggcggcagcacgaacttcttccgtaaagaaagtcagaagcttcagcagagcgctaaaaaacgcgatgctgaattagcgaacggcgccctcggtatgatagagctaaataatgattatacattgaaaaaagtaatgaagccgctgatcacttcaaacacggtaactgatgaaatcgagcgcgcgaatgttttcaaaatgaacggcaaatggtacctgttcactgattcacgcggttcaaaaatgacgatcgacggtattaactcaaacgatatttacatgcttggttatgtatcaaactctttaacaggcccttacaagccgcttaacaaaacaggtcttgtgctgcaaatgggtcttgatccaaacgatgtgacgttcacttactctcacttcgcagtgccgcaagccaaaggcaacaatgtcgtgatcacaagctacatgacaaacagaggcttcttcgaggataaaaaggcaacatttgcgccaagcttcttaatgaacatcaaaggcaataaaacatccgttgtcaaaaacagcatccttgagcaaggacagctgacagtcaactaataacagcaaaaagaaaatgccgatacttcattggcattttcttttatttctcaacaagatggtgaattcaactatggcacgaaaatggcccattgcaatattgatctttctgggtgcgttcctgtttgtcggattactgccggacaaaaaccacaattcctctgaaacaaacacggcacctaaggcggattatcgggcggcgtatcattttacgactccggacaaatggaaaaacgaccctcaaaaaccgatttttttcgagggaaaatatcattactactatctttataatcgggactatccgaacggcaacggcacagaatggcggcatgccgtatcagaggacttggtgcactggacggatgaaggcacggctattccgaaatacaccaacccaaacggcgatatatggtccggttctgtcgtcattgataagcacaacacggcaggcttcggcgaaaacgcactggtcgccattacaacgcagccgactgccaaaacacaagcacaggaacaatatttatggtacagcacggataaaggaaaaacgttcacatcctatagtgatcagcccgtgatgaaaaacccgggcactaaggatttccgggacccgaaagtgatttgggatgagcaggatgacaaatgggtgatggccatggccgagggcgaaaaaatcggtttttatgaatcatccgatttaaagaattggcattacacgggcagttttatcacgcaggagatcggcctcgtcgaatgccctgacctttatacgatgcgtgcagatgatggaacgaccaagtggattctcggcgcaagcgcaaacggcaaaccccagggcaaaccgaatacgtacgcttactggaccggaaactttgacgggaaagaatttactgccgatcaagcagaaccgcaatggctcgattacggctttgactggtacggcggcgtcacatttgaagacggcaacagcaaagatccgctgacaaaacgctatgcgctggcatggatgaacaattgggattatcctgatgaaacaccgacaataaagaacggctttaacggcacggattctatcgttcgtgaaatccgcctgcagcagcaggacggcggcacatacagcctggtgtcagagccggttgaagcattgaaccaattaacctctttaactgacagcattgaagacaaacaggtgaacgggtctgagacactgccgatcaagggtgatacgtatcagcttgatatggatatcgcttggtctgatatcaaaaatgcaggcgtcagactcagagaatcagcagaccaaaagcggcatattgatgtcggtatttcagcagaagacggctatgcctatgtgaacagatcgtttacagaccagcctgataaaaccggaacatatgccgaaagcaaagcgccatttgacggaaacaagggccgcgtccatctgaaaattctcgtggataaaacaagtattgaagtatttgcagacgacggaaaaaccgttctgaccaatgaagtgttcccaaaagccgaagatcagggcattacgctcttttctgaaggcggttccgctgactttcagcatattgagatgaagcatctcggttcgattcattcttaggctccctcttcatttcttatcagcgtccggactgtgttaaaatgcagatatgtatactacgattcatgaggtgttccattggataatcaaaacaaagaacctgtgctgaaaagaaccatcatgcgggacgaagtgtatcacacgctcagaaactggatcataacgggcaagctcaaaccggaaacaaagttaaaggacaaggaattgtcagaaacattaggaatcagccgcaccccgatacgggaagcgttattgcgattggaagatgacggcttggtaataacaaaggcaaacagatggacgcttgtcgctccgattgaggtaaaagaagcggaaaacttatattccattgtctggacgcttgaaaaactcgcaatgcagcaagccctccctcatatggacgctgcagtgattcaggaattaaaacagcttaatgaggatctgcttcaaacgatgaaagacggcgataaaatggccattctggaagcggataatgcatttcatcatcgcatcattctgcttgcggacaacgctgagcttcacaaattgcttgtcagcctgaaagtaaaaattcagagaatggaaatccgctatttcagtgaaaacgacgcgttaaacagatcatataacgaacactcagatatcattcacgcattagaacagcaggatgacggcgctgccctggcagcgcttgaagcgaattggaaaaacagtttagaacgcctgcaggacatgtaatagcgaaacgaaaaagccaaatcatatgatttggctttttttacaaggcagccgcgctggctgtcttgtttactttttgttgtttatatataaatacataccgtaatcggtcggcacagaagcataccccatctgtctgagcatggctgttatattcccgcgatgatacgttccgtggttcacaacatggagaaccatatcggccgccgcggttttcatgatgtcacctgacggatgctctatttcaaggggaaggctgatattttcttccttttgcaaaaatagttgatattggtctgataattccaaaaacatatcttccagctcttctatctctttagataagatttcctctttttgctgatcagctgatttcagcgtatcctccagacgcactccggagaacacatcaaaccatcccttatccgacagatacacatgagtcaatacaccggctatcgacggaaagacactttgaatctccttacggtacacatcctccggaagctctttaagccgggtgaatatttgctgatttgcccaaagatgataatcatacaattgcagtacaggatgttccacaaaaccctctcctctcttggtacagaacgtacgttcctaattataccacgctacatacggctttgtaccgttttcttcatttgaagctgcgaaaatccgataataaccgataataataaaagaagacccgcgccgacataaataaaccgcacgccgaatacatccgagataacccccgttccgataatggaaaacataaagataaactgaactaaagctgatctcgccgctaatatattgactcgtgtctgttcggtcgttatgttttgaagaaatgtttcctgtgtcagatcccttaatacacaagcgggccccatgcatagcaccagaaagagggccagaacggcgctgctgatcagtccataaataaaagtgaacattccatatgccagggctcccgtcagcataaacggaatgaggttgcgctcaaatttaccggataacctatatatgatcaatccgcccagcatcgtcccggcataatagactccgttcacgtatccccaccacgcttctcctttatgaagtacatcatgcacatacgttaaggacacagacccgatccatatcatgcccgcccacgattcgatcacgtccatcacaatgaggattctcagctgtttttgccgaaataaatacacccagccgcttgccgcacttgcaaaaagtgaacgtctcctgactgcttccggcggagcgcacatgtgcacttgaagaaacagaatgatgcccaacaccgaagaaaccagtaacatgacagtgatgataatcgtatagctttctcccaaaaacgcgatgatgacgccgcccaaagaccagcccgcaaactgaacggtctgatccgccgcagataataagccgttcgcttttaccctttgatcaggaggaatgatttctccgatcagcgcgctttttaccggagcgaaccatccgttgcaaaaagaaatccctccgatcagacaaaatagcagaaaaaagaaagcggatgaaccggtttggatgacataaaacaaacagactaacagtatcacctgtatcaattgagaaccaatcagcaaagaccgaagcgtgaaccggccggtaaccagcggcaaaacggcgctgcccaatacgcgaaatacaatgctgacgaacgtcataagagaggccatcgccgtcgagccggtttttgtaaacaaaaacaagatgacagccatcgtataaagggagaaccccaagttgacagcggtctggctgtataaaatagagtaatacgctctcctcatattcatcctctgcaaaacccccgctccctgattatgtaaatcataccataaccgctgatcagcaatcttataaaaacacagattgacatggagtccgctccatctattaagcttttacgagcagaaagatcccctgccgcaaaaacaagccgatgctttcgcgcatcggctttcaaattaacccaaaaatcatctcaagacacaaaagaactttccattttttactgttatgtaaggcgaaacggagaaaccaagtccgctcatcactgtctgcttaattgcttctatgctccacagttccaatgtttgtaaatggcgatacgctcctccaataaagaatgatgaaaagggcttccttcccggaagccctcactccgtctgcttacgccaataaaagaaaaataagcgctaaaacagccggaagtccttgtttcacgataattgatttgtttgaagtaaagcctccgaaaatggccgctatgaccacacaaatgacgaaaaacatttgaatcatatgaccaaccggatcagctccgaggatcagcccccaaatgaggccggcagccagaaatccattatacagaccttgatttgcaaacatgaccgctacattccgatcaccttctaaatgcttcggcaaattgaaagaccgcttggcagccttcgaattgataaaaaacatttcaagtatcatgataaatacatgttctaaggctacaattccgactaaaacagctgcaataatgtccactgtctctctcctctcagctttacttcaaaattatttccattgtgcgatcgtttcgatagggagacggtaggaagcatatccttcgtccgccgcttttccgattgacaaaagcataaccggtacataacggtctttttccagtccgaaaacgtcggcaatcttttctttgtcgtagccgccgatcgggtttgtgtcatagccgtgcgcgcgggccgtaagcatcagctgcatggaaacgaggcctccgtcaatcagaatggtttcacggttcacttgctccggcagtttttcaaaatgtgccgtcaaagcagcgatttgtctgtcttttacttcctgcggcatatagcccagttcgaccgcttttgaataaatttcttctaaatattcatcattcttcatatctgcaaaaaccgcgataaccgcagaagatgtgctgacttgtgtttggttaaagcttgcaagcggtgcgagtttttcttttccttccgggctgtcaattacgagaaaacgccatggctgcgcgttgactgaagacggcgctgtcgttgcttcttccaggatctgagtcatttcttctttgctgatttttacggccggatcataattccgaatagaacggcggcctttcataatgtccataaaatcgtttgttttcagttctgttttcatgtgtaaacactcctatgctttcatattctctatatttttttgcagctgtgataatacgttttttagcatactgcgttcttccgcgctgacgccggcaagcatttcttttatgaaacgctccttctcttttttggaagtctcaattctctcccgcccctgttcagtaagcctgacaagtatgattcggttgtcctcgggcttccgtcttcttgtgaccatttctttggcttcaagctgtttcaagtgtcttgtaacggctgcgccatcaatattcacctttttctgaagatcgctttggctgatctcatcaacgtgaaagagcacggcgagaagctcaaggcgggattggctgattccggtgcacgcttcaaattttgctccgatcactttatgcagtgattgaagctgatataaaatctcgccttcctgtgaacaacatgttgtcaaaacccatccccactttcttatgcacaattaattgactagtcaatgtttgatacatcaataatatacaaccgccactctttttttgcaagttttttctcctttttttaaaaaaagctgccggttaacggcagctcttaatgattatgaacttttctgaaattactgccttttacttcagccacatcatagaccgtcacaaaggcttgcttatcaatgtcattaataatttccttcagtttggtttcttccaaacggttgatgacacatgtgatttctttgaatttttcatgagaaaaaccgccgtatgcttctttgtaagtagcgctgcggcccaattcctcacgaattgtctctaccattaatgcaggctcgttggtgataatctgaaatgttttagaaccgcttaaaccttcctcaaccacatgaataaccttagacgcaatgtagtaagcaatgacggaaagcaaagcgccttgcagcccgaacacaaatgaaacgaaaataaacacaaaaatgtttaaaaataaaatgaggtcgctcgtgccgaatggcaatttccgtgacagcagcacggccagcatatcaataccatctaaagcgccgccgttgcgcaatgccaatcccattcccagaccaagaataatcccgccgacaacggtgattaatagggtgtctccctcgatgattgccggagtgtggtggaaaaaaaccgtgcccgcggcaagtgaagcaataccgataattgacagaaacgcaaagtttttcccgatttgcttatatcctaaccagacaaacggtatgttgatcgccgcaattaagatcccaagaggcagatgaaacagctgtgaaccgacaatgctgagtccggtcaccccgccgtcagatacgctattcggaatcaatacggtttccagcccgtaagccgctataattccgccgataatgaccataatagcccgtacgatagattttgctctggatttcttacgtttttgtttttcgattgtactcatctcattccccgcttcaattattttgtcttatttaaatataccataattgatacttttcgttaaaaaaacaagcctgtcagacgattttgaagcaggaaccaaaaaaggtgattttacagataacatatccatttatgatttttatcattcagaataaaaaacagtaaaaggaattaaaatccattaatattctcttttgtttcccttcttcacatactcccaatcatgttctatattttttctcacccgctgaaggaggctgaaaatggtttctttttcctcaggcgtaaagccggacaaggctacttccgcagagtgctccccttctctttgcaataacgggtaaacctttctccctttttcagtcgggaacagtttttttatttttttattttgatcatcaggacgcttttcaataaacccttgtatttccagtttctttatcgctctcgccgctgttgttcggtcaactttaatcatttccgccaatttctcttgtattatccccgggttttcacatattcgcacaagatagaggtactgccctttggttaagtctaattctttaaattcaatattgctgatggaatccaatgcccgtgcgatcatgccgatttcccgcaaaatatcagtcatatcttttcaaacccttcgtattttcattgcatttgcaataaaaatgttttatcgttacttctataagaccacaagcaagccgtgcagtccagactaatatgtgaaaaggattgattgatcatgaagataaaaagaatcacaacggaaaatgatttacaagcagctcttgatattagaaaaacggtattcatcgaggaacagcaagtacctgaatctgatgaatttgatcagttcgatacgcttcaggaacagtgccgccatatcttggtttttcatgaaaatcagcctgtcggcacaggacgcgtccgcatcgtaaaccacacaggtaagctcgaacgaatctgcatcctgaagccttaccgcaaatacggattaggcaaagtgatgatacgcgaattagaaaacatcgtgaaagaaaaaggcatcactcaatgtaaactgcatggacaaacacatgcggaaggcttttatcaaaaactgggctatcagacaagttcaccggaatttatggaagacggcatcccgcatgtcttaatgacaaaagagttggcttcgcctaatgacagtgaaacgtccggatcccttcttttttgatctttttaaaaaacgaatcagaaagaagacgcttcagcacgcccacaaccctgtgaaccggtagaagcctttgaaaaacgcgaaaacaagccggttcttgtcagcatcggctattcgacttgcttgtcagatacccactctagagtcagcaggattcataaagaagggagagagtcccttctccatcccgattttgtctagtcccaaattaaaggcctatccacttcagcagttctgagatagtctaaaagttgaccagtatgtactgattcatgataagcgattcttaacaacatgtcccctagttcccgaacatatccaacatcagacctgtcaatctttatatttgttaaatctgtttcgtttaaagatttgatgaatgtcaaaaactcagcccgaaacggttttgcaaactctaattcttcggctactgtggtaaaagtttttgattcataaggattaatagattcctctgaaggctcattcatttgttttagcaaaattttatgataaagaaattctgcttctaaaacatgtcttatcatttccttacacgacattgcttcggaatccgggcgccaatccatagtttccttaggtatacctgtccataacttgacgcttcgccgtctcacttcttcaaaatttaaaacaataagatcaatagtattcaagtatttttcccccttttattttaaaaacaaattctccttttttcctgaaaaacctccatgagctgcttcttaaaagatctcaattggagattttctgcccggataccaatagagagatcataaaattattatagaaagtcaccttacttcaaaagtatatatttatctgattgccaattctttaataatcaaactcaattcataaattcccttttgaaggtcttcaagagatgcataagcatatgataagcgaacaaaattccctttctcctgagcatagatactgccgagattgagaagtatcccttttgttaaagcttttgtataaagtaatttcatagatattgaaggcaatatttttacccagacaaagaatcctcccttcggaatattccatgtagccacattcttcaaattggtttctaaagcactcatgaccaattgccttctcacctttaattcacttctaacctgttctagatgccgctggtattcaccggatgtaaaccactctgccgctaccctttgagataatgaactggatccgtaatctgtctgcattttaatatcagataaacgttcaattaccggttccggccccgctatccatccaattcttaatccggggcttaatgtcttagataaacttcctatgtaaagcacatgcccatttttatctattgttttaataggatctggaggaatttcatctatccataactcacgataaatgtcatcttcaataattggaagctgtgcattctcacttgccgcaaggatttcttctcgcctcttttttgacattaaaatacctgtaggattatgaaaacagggatttgtatataatatggctcttccccgttcttcctttgtcatatgaatatggtttggcagaagcccctctttatccatagggagcccggtaagattcatcccggctgactgaaatacatgcagcgaataaagataagagggctgatcaagaaaaacggtagatcctctttgcaaaagccccattgatataagctgtaaggcttgcagcgctccagaaacaataagtatagaagaaggtgaagcacgaattccgaatgtttttaaataatgactcaatgcctctcttaaaggtagatatccttttggttcctcatatccgaatgcctctatgttttgtgatacctttcccataatctctttcatagcagctaaaggaaaaatctcgtttgaaagctctcctttgctgagctgtataagatcagggtttgattccgatttattgatctcttggacgattcttctgcttggctgctgaattccggaggttacatattgatcccaatcgggggcggaattcttagccaaaagtgtccatgtattgttaataacaactgtgcctttacccattctgccttcgatcaatccatccgccatcaattcctctaaagctgtaattaccgtgcttctgtttacttcaaagtatttagcgagcgtgcgctggcttgggatcttacttccaatcggccattctccatttccaattttctcttttatataatcaatgatttgtaagtattttggcagttttctaaccgtttttccttctgtaaagctcataaaaagcaatctccttcattataagtggttgggtcaacacttgattaactggttgaagccattttactaattctctattagtataaaacacattaagagactggttggtttttataagagaaggagtgaaaattttgaataagaaaacggttcgaatctgtatatcttacagtctgatgattgggttgtgggcatcagctttcccgggaatccgcgcgggtttggagagttacacgccggaacacctcgctttgtttcgcttattgattgggtcgatggcactgttgctttttgctgttttgactcaaatgcgtttacctgacatgaaggatatccctgctattttatctttaggagttttaggtttcgcactgtatcacattttgctgaatatcggagaaaaaacagttagcgcagggatagcaagcttactcgtaaccacggcaccgattttttctgcagtgttatcccggcttttttgcggtgaacattttggatcttctaaatgggtcggatctatcattagcttattgggtgtagcatgtatttcatttgggacagcagactatactcattcaatgaaaggcatgttattcattctgctggctgctttttcagagagtatctattttgtctttcaatcccgctatataaaaaaatatggttttattccatttgtgacattcaccatttggggtgcaacattgccaatgctggtgtttcttccggggttatggggagaagttattcacgcatcgatgaattccacattgtctgccatttacttaggtttattaccaacagttatcccatactttgcacttgcatacgtcacttcactcgtcggcgcttcagaagcagccatttcactttatttaacaccagctatagctttggtcatttcttggttgtggttaggtgaaatacctgcctttatttctcttctgggcggagcagttacagtctgcggggtatgcttcacctatctggaagcaagtaaaatcaggcttaaatgaatctttttagagaattgggtatgttaaacgtacaattaaaagaaagaaggtgatcccatgcccgctaacaataaacccaacagtttaatcacggagaagtctccttacttactccaacacgcccacaacccagtggactggttcccatggggagaagaagcctttgaaaaagcaaaacgcgaaaacaagccgatactagtcagcatcggctattcgacttgtcactggtgggatgtctgttaagatacccaaatatgtcgttgaaataaaataaattgtaagagatatttacaacttaaaatgaaaaataaaaaagtagattgattaaaaatcgacttttcgcattaaaatattaaatcttttaatgaggcttagttgcaatcttggagctgacctctgagttactggagtttaaattaattacatcttcaattggaataatctcgcttggggaaacaccatgaagggtagcacctttaactgcaactcctatgacttcattactttcatttattataggtccgccactgtttcctccgtatatgattgccgatatttcccgtcgtgaatggaacgttccggttgaatctctatgttttctaataccttttaggtggccagtttcgatttttatttcttgccctattttgtagtctggataccctattaattcaattttctgcccatctttcatgtcaatgttatattcatatccttgattgtctatattaaaaccttttatatctaaaattgcaatatctttatctaggtcatatttggatactttcgctttatattttaaatcaggataattacctctaaaaaatgagataccatactcattgttaaattttttattgtccttaatagcttctattgcatcttctataacgtgagcattagtgattaagccaactccctttaataaaaagcccgttccttgaccgtataatatttcctccattttatcgttttcaaaacaaactaaaggaactttatcatcataatcaattatatatgtataagtttcatgaaatttctttaaagattctaatttaaaaggagatatagtttcactaagataagatattttattaaatctctttgctaatttcaaatataaagggtcatcttttccttttacatgcccaacatgtgaaatcataccttttaaaatagcaaacatattaatattatcaagatatttcttttgacgaaatgggtatttttcttcgaaaatttgttctgctttctgtaaatcttcaacgtttttttcaatacagtgaagaattgaccttattcttcttacatagcttcttttaacatttaatttttcatttaccgtaattcccgttacagtttgattttgtctataattctgaagtcttgtcttttctttattaatcttaaacccctgatattccacaatactaattacattactattcagaaaaatagacccctcttttatatatgcaatatcatgagggaaaaccctcctgcttgtagaaaacgttatatcgtcagcatacctagtatattgacatctgttgtttttggccaatttagaaaactctttatctattctattacatataatatttgatatgataggggatgttgctgctccctgtggcagaaaaccattcggatgacaacatatatttgctaaggttgtagcaactttttcattaaatttataatatgtcataaacattgatctaactcttctaaaggttatactttcgaaaaaattctctatatcaaaatttagtacatattttttatttaaatgcttttgagcattatcaactattcctcttccttttacaaaaccatatgattgcctatggtttttatagttagactccaaaatataagctagctttttttgcagaatagataaacttaaagtaggcgaaaaaataacacgttctgaaccatttttcttttttaatttaaacgccttataattagctcctttattttttataagtactttccacaataattcttttggtacctctaaaaggagagctacatcttcaaaacaagataaattcttgaaattttgtttaatatcctctagattgctctgtaattcaaaatttaacttataaaccatagcaatcccctcctatttacaacagcaagggttaaaattctacccttctcctaatagcgattagacaaatcgaataaaacttcgaagataaaataagcgtgtaaattaagtataccctttaaataacagacggcgatttcaccgccataaagtcaattttttcttacccttgctgtcagtgtaaattatactatatatattcatcaatattaacagcatttttgaaaagtttatatttaatcgcgatgttttacattatcttacctactgtaagtatttatgataatgaaatgtggtaagctaacaacataattattaacgaaaaaagaggtacttatatgcctactcacaaacataccaacatgttaatcacagagaagtctccttacttactccaacacgcccataacccagtggactggttcccatggggagatgaagcctttgaaaaagcaaaacgcgaaaacaagccggttcttatcagcatcggctattcgacttgtcattggtgccacgtaatggctcacgaatcctttgaagacgaagaaatcgccggtatgttaaatgataaatttatagccatcaaggttgatcgtgaggagcggcctgatgtggattccgtgtatatgagaatttgccaattgatgacggggcagggcgggtggccgctgaatgtgttcgtcacacctgatcagaagccgttttatgcggggacgtattttccgaagacgagcaaatttaaccgcccgggttttatcgatgtgcttgaacatctgtccgaaacgtttgcgaatgatcggcagcatgtcgaggatatcgcggaaaacgccgccgctcatcttgaagtcaaagttcatccgaccgagggcatgcttggcgaacaagcggtacatgacacgtatcgtcagctggcaggcgggtttgatacggtgtacggcgggttcggccaggctccgaaatttccaatgccgcatatgctcctgtttctgcttcgctactacagctatacgggcaaggaacaggcattggccggcgtaaccaagacactcgacggcatggcgaacggcggtatttttgaccacatcgggttcggatttgcccgatactcgactgataatgaatggctcgtgccgcattttgagaaaatgctgtatgacaacgcccttctcctcagcgcttatacagaagcctatcaagtcacgaacaatgagcgctacaaacagattgcgacgcagatcgtgacgtttattcagcgggaaatgatgcatgaagacggcagctttttctcagcattagacgccgatacagaaggccgcgaggggaaatattacatatggtctaaaaaagaaatcatgaatctgctcggggaccaactcggctcactttattgcaaggtgtataacatcacagaacaaggcaatttcgaaggagaaaacattccgaacctcattttcacgcggcgtgaggccatccttgaagagaccggtcttactgaacacgagctgaccgaacgccttgaaggcgcacggaaaaaattgctggaagcgcgggaaaacagaagctatccgcacacagatgacaaggtgctgacctcatggaacgcgctcatgattgccggactggcaaaagccgcaaaggtatttcacgagccgggctttctcagcatggcggaaacagcgatccgttttctcgaacggcatctcataccggacgggcgcgtcatggtccgctatcgtgagggcgaagtaaaaaacaaagggtttatcgatgactacgcttttctgatctgggcttaccttgaactgtatgaggcaggttttaacccgtcttatttgaagaaagcgaaaacgttatgtacaagcatgctggatctgttctgggatgaacggcacggaggatttttctttaccgggaatgatgccgagacccttcttgtgagagaaaaagaagtctacgacggtgccgtcccttccggaaacagcgcggcagccgttcagctgcttcgtctcggccgcctgacgggtgatgtatcgctgattgaaaaagccgaagccatgttttccgtttttaaacgggaaatagaggcctatccgagcagcagcgctttcttcatgcaaagcgtactggcgcacataatgcctcaaaaagaaatcgtcgttttcggtagcaaagatgacccggacagaaagtggttcattgaagcgcttcaggagcatttcactcccgcctatacaattctcgccgcggaaaatccggaagagcttgcaggcatttctgattttgccgcgggttatgaaatgattgacggaaaaacgacggtttacatttgtgagaatttcacctgccgcagacccaccacggatattgatgaagcgatgaatgtattacaaatcagcagcagagcctaggcggcctgctgcttttcttttttcacaaaacggaatgcgagccatgcgaagatcatattgatcaccagactcgatatgcaatcatatatttcatagccgccggctgatgaaaatatcgatggaatggcgccgtaaaccgaatgatcctcggtgagaaagataaataaaaacatattattggcagcgtgaccgcccagggacagctccagactgcccgttttaatcgtgataaaggtccagatcacaccaatggtgacatatccgattcccgcccagagagccccattttccatctccggatttccgaagtgaaggacgccgaataatccgccgatgatggcagtcagaaccaccgcgtttgccgtcaatttcccggcgaactgaagcagaaaaccccgaaagagaaattcctccgcagaggtttgaatcggcaccaaaaagacggccgccgctaacagcagcagaaagcgcgaagcatggaattcctgaagcgagaatcgatccgggtggaataaaaaatcaaccagccccgcaataaacatcagcaaaatataagtgccgaatccaaagaaaatcctcttccagttcagcgactgattcggtgtgataatagataaaaaccgccgtttcataatgaaacgaaccgctatccaaatgcctggaatcgctatgaagtagacgatatgctgtaaataaatatccgccagcgggtcacctaatgccaactcatcccagtttatcgtcaatgacggattgaactcggatatgagaagcatataaaatacggtcaatatgcttccgaataagaacaaacccactatgaccagcagagaaagaagatatctccatacactattttttccctctgcgggccgtacaaaagtattcatatttatgcatcagcttcctttccttcaacattttacaatagaaacagaaacagatataggaaatttcatatatttttaagaagaaagcgctatgccgtttccttcggctctggttatttacactctgtttttgccaaaaaaagacctttataatgtatttgtcagattaatttacagtattttctgattacaattgccaagtcagggggttttttatgaaacatcagacattctcaaatgtagcgaaccgtttagaccgtctccccatttcacgtgtgcactatcaagtattaaccgctctcggaatcatctatttttttgatctcgctgatctgtttacgctcagtaatgtggctccggcgctgattgagcattggggtgtagagctgtccaccattgctgacattacggctgcatccttcttgggcatgtttttaggcgcctctctcggcggaaggctgtccgatcggatcggcaggaaaaaagcgctgaattgttttgtccttatcttttcgatctcatcttttctgaatgcgctggcatgggacattccttccttaatgattttcagatttttgacgggtctcggcgtcgcagccgccatgattgtgacgaacagctacttggcggagttctttccatcctccgtacggggaaaatatatctccttttgcgccatgatcggattaatcggcgttcccgtcacaaacgtcgtatccgcttttgtcattcctttaggctcatggggatggcggctcgtctttgtatggggcgcggccggtctcatttatttcttttttatccgccggcttgaggaatcgccgcgctggcacgaaaatcgcggtgcatataaccaggcaaacgccattatgaatcggcttgaaacccgtgtagaaaaagaaaaaggcccgctccccgcaccgaaagaagcagcagaagtacatgccgtgaagcacgccggctacttaggactgtttcagggcaggaatctaaaaatcaccatcatcctgtcagcggtatggatccttgaaacctttggcttttacggctttgcctcatgggtgccaagcctgctgaaaagcaacggcatcaccatggaaaaaacgctgtggtacaatgtgctgcactctgtcggggccccgcttggcgcattgctcggatccatgatatccgaaaggttccaaaggaaatggattctggccgcaagcgcttttctgactgcagtcgccgggctgctgtacggcatgacgtttattcccgtcatgattattgtgtttggatttgtcgtcaacgtcacagaacggatattcacctcaaatctatacgcatacacatcagagccgtatcctacggaatatcgctcggcagggagcgggctggcgtacgggctcggccgtttttccaacatattcggctctttgctcgtcggatttattgccataaagctcggctacatcagcgtctttttgtttatcggcggctgctggctcctatgttccgttctgttaatcctcttcggcccgaaaacaaatgcacagcaaatttaaacaataaaacagtgcggactcactccgcactgttacactgtgatttctatcaaattgccttcccaatcctctatcacgctctcataatatccgtcacccgtcacgcgcgggccgcttacaacctgaaatccgtcgtttttaaacgtctccgtcagttcattcacccgctccttgctgcctgtagaaaatgcgagatgcgcccacccggtcatattctgtgacggcgtttcctcaatgccgccttttttcataatttccagccggcatccggagtcaaatgaaagaaaatacgatttgaaatcctttttctcattatgataaaggtcattggcttttgcgccaaagtatttctcataaaactctttcattcgttctaaatctttcacccatatcgctgcatgttcaattttcatatgtccgcctccttttttttctcaatctatttataagccatgaaatccatttcagctcaagtctttttccgctgaaattggtgcataatttgttttttagccgtttctccgttcaaaaacagcaaaaacgcttcctttccgacccgttccaaatgaagttccaaggaaggaatattcaaagcccggctgacgctcacatttccctcgccgatgatctccacgtcccatttctgttctttcgcaaactggtacaagccggcagccacatcatcactgtgtgcataaatagccgtcggcggcttgctgaaaccccggaagtgctcaccagcacgctttccgtcgtccatatcgtggcatccgattagaatgcgggtttcatcaaaagaaccgaaaactgctttataggcgtttaccttatcggtcgtacttgggctttttgccgcttcccgcacacatgtaaaagcaacgtctcgatgcccgcggtttttcaaatacaaaaagctctctctgtatgccgcctgtctgtcattataagcgcagggaatcgcttggtgctgtgtatattcacaggcgacaatggggccgtattcaaggtaaggcacggctgtttcccattcattcgcgcgggaggtgacaatcagtccgtcaatctttttcattttcaacagttcgaaatatgtaatctctatagcggggtcatagttggtggggagaagagttgtcacgtaatcatgggcaaacgcttccttcgtgataccgtttacaattttgtcaaagcagggatgatcactgtacggcaatatcacgccgatcgtattggtctttccgcgaatcagatcaatggcggttcgattaggcgtataatccagctccttcatcacttgattcacaagacgccttttctcctcagatacgtacggatggttgtttagcacgcgtgatacggtagccaccgacacattcgccagtttcgcaatctcttttatatttgccatgtgctcctccattttcggtaataaaaaagcagcaagagtgaatttctcttactgctatctcatcataaatccagtgtcatttcaacagggcaatggtccgaacccatgatatcggcacaaatggccgcctgggtgatccgctgcttcagcctgtctgaaacaataacataatcaagccgccagccgatatttttctcgcgtgcattcgtcctgtaagaccaccaggaatacgcgccttcctgatcgggatataaatagcggaatgagtcggtaaatccggcattcagcagtacgctgaacgcttcccgctcctgatccgagaaacctgcgttctttcggttggcttttgggttcttcaagtctatctccctgtgcgcaacattcaaatcgccgcataatatcacaggcttcttctgatcaagcttttgcagataatccttaaaatccgcttcccactgaagacggtaatcaattcgctctaacccgcgtttggcatttggcgtgtaacagttgacgacgaacacattctcaaactcaagcgtgatcacccgtccttcttgatcatggtcgtcaattcccaatccataagaaacttgcagcggctttactttcgaaaaaacagccgtccctgagtagccttttttcactgcatagttccaatagtcatggtatccttcaggctgcaatgatacttgtccgtcctgtacttttgtttcttgcagacaaagaatatcggctttcgtttcctgcaggcaagtattgatatctatctttttcatcacggcacgcaagccgtttacattccaagaaatcagtttcatgtgttccctcccgcccggctcagccggtattaacaatcttacttcagtgtttcaatgtttctgccctctaatgccagcagctgctttttcatttctaaaccgcctctgaatccggtcagtttgccgtttttcccgatgacacgatgacatggaaccgtaatcaacaccggatttgccccgattgcggcgcccacggctcttacggctgtcggtttctgaatcatttctgcaatatccgaatagaagtatgtctcaccgtacggtatgtccatcagcgcttgccatacagccagctgaaattctgttccgtaaagatccagcggcactgaaaatgctgatctgccgttttcgatgtactcggacagctctgccgtgtaaggcgccagtttttcatcatcacgcaccaagcggtgttgcggcattgcttttcctgtccaccgctcaagctcttcaaagtttccatgattcgaacctataaagcaaagccccgtagaagtggcggctgtatacagactccactcattccgtgtgaagagtgtccaataaaccatagtctctttactcatagtgaatctctccccgtccctttccggcagtttttctgtatgctgtaggcgaacttcccgttctctttttaaaaagagtcgcgaaatgtgctgtgtttggaattccgacagtcagagcgatctccataactgtcttatcagtatagagtaaaaggtgttccgccttcgtcagtctttttatctgaatatactcaatgggagacagccccctgatttttttaaatgtccgctgcaaatgataggggctgccgtgacacatatcggccagcacgctcagagtcagtgattcgtgatagtggctgtcaatatactcggtgatttgcgcaatccattcttcatcaggaagacgcagaccgttgggacggcaccttttacagggacgaaaatttctctccagcgctgcatcagccgtatcaaataccagcacgtttttcttattcggaactctcgacttacaagaaggccggcagaaaatccccgtcgtttttacggcataataaaatgtcccatcataggaagcatcattgtgaatgattgcattccacttttcatctgtcaggatatttctttccgttttcatctcagccaccccctgtttctcagtataaacaaatccattacataagtacgcttatttgaatagaggagcaagataacaaagataagactcagaagcatttctatgtttcatgtggaacatttcggcagggggttgagtgatataaaaaaagagcaggagcccgcgggctcttgctcttttctttcggcttactcgccagttacgtatggaagtaaagccatttgacgtgcgcgtttgatcgcgatagtcaatttacgttggtatttcgcgtttgttccagttacacggcgaggtaagattttaccacgctcagaaacaaactttctaagaagatctacatctttgtaatcgatgtgcgtaatgccgttagaagtgaagtaacaaaccttacggcgtttcgcacgaccgcctctgcgtcctcctgccattgtcatttcccacctttcttgttatgaatatagcgataatctattagaacggaagatcatcatccgagatgtcaatcggcttgccgtcgttggcaaatggatcatcattaaagctgttcccttgatttcttctctggttgttctgatttccgccgaacggattatcattttggcctccgccaaagtattggcctccgccgctgtttccttcgttgtatccgcctgaaccagaaccgccgctgtttttaggctcaagaaattgaacactttcagcttggacttctgtcacgaagacacgctgtccctgctgattttcataatttcttgtctgaagacggccgtctacgccggcaaggcttccttttttaagaaagtttgcaacgttttcggcttgttttctccaagtgacacaattaatgaaatcggcttcacgttctccagactggttcgtgaatgtacgattcacagctagagtaaacgtggcgacagccgcaccgcttggcgtataacgaagctctgggtcttttgttagtcttccgactaatacaactcggttaagcatatgaaagaccaccttttaacattatatatttcaaattgcttattcttcttctttaacaacgatgtggcgaatgatatcgtcactgatcttagctaaacggtcgaattcagaaaccgctgcagcgtcagactgaacgtttaagatttggtagaaaccgtcacggaaatcgttgatttcgtaagcaagacgacgtttaccccaatcttttgttccagtgatctccgctccgttagaagtcaaaacgttgttgaaacgctcgataactgccttctttgactcttcgtcaatgttcggacggataatgtacataacttcgtactttttcatctgtttgcacctccttttggtctaagcggccctataatgggcaaggagcaataattctattactcacaagtttatattataccaaagctcttgtccctttacaactgtgtcctatacattaaatcggaaatgaatgacatctccgtcttggactacatattccttaccttccagacgcacttttccggcttctttcgctccggacattccgccgcctgccaaaaggtcttcataagcaaccgtttcagcgcggataaagccgcgttcaaagtctgtgtggatgatacccgcacactcaggagctttcatgccttttctgaatgtccaagcgcgcacttcctgttcccccgccgtaaagtatgtcgcaaggccgagaagagagtatgacgctttaatcagctgatcaagacctgattcttcgatgccgagctcttcaaggaacatttgcttttcttcgccttccaattcagcaatttcagactcgatttttgcacagacgacgataacctcggcattttcccccgcggcgtactcacggattttcgcaacgtattcatttcctgaaggatcagccacttcgtcctcgctcacatttgccacataaagcacaggttttgacgtaagcaaatgaagctgcttcacaagcttttgctgttcttccgtaaattcaacggaacgggcaggcttttcttgttcgaaagcttcttttaatttagacagaatgtcaaactcaaaaaccgcttctttgtctttttgcttcgcaagcttgcttacccgcgtgatgcgcttttcgactgtctccatgtcggcaagaatcaattcaagattgatcgtttcaatatcatcaatcggatcgactttccctgacacgtgcgtaatattgtcatcagcaaatgcgcgtacaacgtggcagatcgcatctacctgacggatatgagaaagaaacttatttccgagtccttcacctttagatgcgccttttacgatccccgcgatatcagtgaattcaaacgcagtcggcaccgtttttttcgggtttaccaattcagtcagcttttgcagacgttcatcaggcacttccacgattcccacgttagggtcaattgtacagaacgggtagttggctgattcggcaccagcctgggtaattgcattaaacaacgtcgattttccgacattcggcaaaccgacaattccagcagttaaagccattctttcatctcctctatatcaaaccatcatcgtataaacgtattgtaaacctagagcaattataaggaggttcataggaaaagacaagctgagaaaaaagcatttcccgcactctctctccttagattatccttttttaaccgctaccagacagtcaaaaagcgtacttcccattccattatcggaatttgaatcctttgtgagcatgttgacggagcctccgaatgccgaccacatgccttcatctatattcaccgtcttggggtgagcctgcttcatgattttcaccctgccgcgcagacgcccgcggtcattgtatacctctgccgtatctccgtcctgaagggcaagctcctcggcgatatcaggcgacagatccacctgaatctgctgaagtttttcaataaacggcacgtgctgtgaatggttagagcgctgcgggtgaatggacagcagcgtatacggatatttctcggccagcccgccgtcgtgataaacagactcctccggcacttccaatcgagggaggccgctgtatcctttctcttctgccaatgacgagatgaattcaaatttcccgctcggggttaaaaattggaaatcatcccacgggacctgtttgaccggaagcggcatatggcctttttcctttaatcgctcaagggtgatcccctcttcctccaaagaagaaagccccatcttcaagaaatcttccgtacgataatcaaacagctctccgaatccgagacgctttgccagctccgtccaaatccatcggtctgatttcgcctccccctgcggttccacaagcttctttccatattgaacatagtgatgatacatgctggagtaataaatatcttcctcttcgaaaacagcggccgtcggcagcacataatcacagagctttgccgtatcggtcatgatcgaatcaatagccactgtaaccggtgttttttcgaacgcttccttcactttttttgtattcggcacttgtgtcagcggattgccgcacgtcacgatgatcatctcaatcggcgggtcggctgcattcaacgcttcttcggcttgagtcatcatcgaaaacgttcttgcgttttttttcagatcaggacgggtgagttcggttttcgcaaagctttcaccgacttgcacatttccaaagtttgcgccgccgcctttaataccgacatttccgctcgccgccgctaaagcgtcaatccagcgtatcgtcccgccgccgtttttatatctctgcatcccaagacccataaaagtagaagcgggaccgtctgcatatagatcagcaagatattcaatctcttctaaagacgtttctgttttctcaatgatctcatcaaaagaaatcgcgcgcagcagcttttctatttcttcaaaaccgactgaatgcttttgaatgaaatcggcatccgttctgccggtttggcataatactttcaaaacaccggccgcaagccagccatccatgccgggtttgacggatatataccggtcggcaagctttgcggtcggattaaaaatagggtcgatgaccgtcagtgtcgccccttttttcttcacctgctgcaaatgatgatagaggtgcatattcgtccgggacacatttctgccccatacgatcacatgcttgctgtgataaatatcaagcggtccatgcccgtaagagcgcccgaaatcccagcgctgcgcttcaattccggaaccccagcaaatacttcccgcaatctccgtcacaccgccgtatccattgaaaaaacgctggtcgagcgccttcaaaagaccgttatttgcgtagtcatgactgtgcagcacagcggcagtgccaaacgtttccttaatcaccgccattttttcagcaatttcatccaacgcctgttcccaggaaatgcggacaaattcgccgtctatctttttcaaaggataacgaagccgttccggagcattcgttttcgtctccagcattctgccccggccgcaaatttttccttctgtaatggggtgattcgggtctccgtctactttcgtcaccttcccatcttcaactgtcaccaaaaagccgcagctgtcccagcaattcagcgggcacgctgactgatgcactttgctcatcgggcctcttcctctcctctatatgaaaaagcatgagcgccagcctttatgatgtaggctcctcatgcttgacgagtacttttttcagctttctctcaaaatctcttctcggaatcatgacactgtgggaacaccccgtacatttgatccgaatatccattcccatccgaatgattttccacctgttttcaccgcaagggtgcggtttcttcatttcaacaatatcattcaggccaaagtctttatccgccaagacccttcacctctcttcatagactgctttatttattgtacaaaaaaagacaggataagagcaacggccgcactcaaaatgagcattatacttttttccatcttcctaatatagggtaaagaagaagacataccagcaaataaagacttaatagcccgtaaatgggatacaaaatggcgattaaatctgaaaagccgattgtcgtaaaaggcaccatcacagctaaaagaagaaagacgagcatccatctcggcaatttcacaaatacaagcatgcggctggacagcccgaacaggccggtcacggttgtcgtatagatggctaaaaaaagtaccgcggccatacaaagaaataacggataaggagcgccttcaaggacggcaaagagaggaatctcgtattgtgtgagactgcctgaaagctgcacaagcgtttcattgtagacaaaagaaatcacaccaaaaataagcccgcttgcaatactggcgattttcgcttccccaagccctttcatatcctttccgacagaagaaagaaccgccacaacagaaaggatgtttaatgacgtaaaggtaatacttgccggccaattaaattgccgggtcaaatctatcgtccacgtgtaatgatgggttgtctgaaaaaagatcaatgcatataaaagcccggctacaagaatcggtatcaaaatactattcaaagataatattccttttatatcccaaaagaataaaaagacggtcacgatgcaaaaaagagaaataccgatccaaaacggcagcttgtacatttgcagcgtcacaccgcctccggcaatcatgaccgtcgtcgttgaaaacaaataaaacataataagtacatcatagattttggcaagagccggccccatcagatgctcaagcacaggtaaaaagtgcgttgattgaacacgatagctgatcttcaacactatataagccgaaatggtgaacatgactgtaaacaatataatagccagtccgctttcaacaccgaaaaactgccatatttcctgcccgcttgcataaccggccccaatctggctgcttaatatgagcagcatccacctcatcccggctctccacacccttatcacctcataaaatttcagataatctccgcatattgctactatattgagtgacagcggcaatcattcatacaaacgggacaaatatggtatgataaaaataattgactaatcagaaaattattttatgaaattattataaggagcccaaactcatgtacatcaggcgtttaaccgcaagtgatactcagccctattccaacatcagactcgaagctttaaaggatcacccggacgctttcgccgtcagccataatgaggagaaagaatggctgcccgaaaaattcaaagccaggatcgaagccgacaatgccatcatgcttggcgcttttgaaaaagacagactgataggaatcattaagatatccaagcagcctctgtataaactaagacacattgcgattatcggttctatgtatgtttctcccgaataccgggggtcaggcgcaggaaaagcgttaatgaccaaagccatcagccaggcaaagaagatgaaagacacggaacagctccatctctcagttacttcaacaaatgaacccggcaaaaaactctgcgctcaatagaattcacctacagaaaaagatcacacggtcttatatctttcatgaacttagagaacaacagctctaagttcttttttctatcccgctcttttcaaacaatcggtatgctgatcactgcataagcataaaaaaaggcggtgctggatatactgtaaacaaccatacatcatcaaaaacatcagtgtaatactcgtatgacatgacaaggaagtgaaccctatgaatcgaaaaggcgggcttttttctcaagaacgggcaaaacaatatgtgtctcatacagattcttctgccgcgaatcaaatacaagcgatccttgcttcatctttacgtaaagcagccggccgaccgttagtcaccgtatgtatcggtacagatcgatcgaccggagattcattaggtccgctcgtaggaacaaagttagaaaacatgaaattaggcaggttgcacgtttacggtacactgtcagatcccgttcacgccgtaaatatgaaagacaaactgaaagatattcaccatatacataaaaatccgtttattattgcggttgacgcttgtttaggccgcgttaaaagcgtagggtcatttcaaatcggcgatgggccgctgaaacccggagctggtgttcaaaaagaccttcctgagatcggtgacgtccatatcaatggaatcgtcaatgtcagcgggtttatggagtattttgttttgcagaatacgaggctccatcttgttatgagcatggcgaatgttttagcagagggattacagctgacagataaaacagaaggccgccaggaacggctcagtccgtttcataagctgacaagacgtatataaaaaaaccatctttttttaaaagatggtttttacgcttctctttcagacaaaagctcaaggatacgttcaaggtcttcatttgagaaaaactcaatctcaattttcccctttttcttttgtctcttaatattgactgttgttccgaagtaattttgcaaatacgattcccgctcttttaacacaacatcttgaacaggttcttttttctttgtttcacgtggaacattactgtttaattgctgaatgagctgctcaagctgacggacgttaagctgttcttcaaccactttcttcacaagcggttcaagcttgtttttatttttcaaaccgagcagggttctgccgtgccccatggataacgtaccttctgcaatgaggttctggatgctttcaggaagcgtcagcagtcttaaatggttggcaatatgaggtctgcttttcccgagccgtttagcgagctgttcctgcgtaatatccaaatgcttcagcagtgaatcatatgcaagagcttcttcaagcggtgataaatcttcccgctgaaggttctccaatagggcgatttcccgcatcagcgattcagataactcccgcacgatagccggcactgtctctttaccggcaagttttgcggcgcgataacggcgttcgccggctacaatatcgtagcccttcaatgattttctcacgataatgggctgaagaatgccatgctgaatgatggattccttcagttcagctaatgactcatcatcaaattgttttcttggctgataaggattggggcgtaaatcactgatcttaatctcttccactgtctcttcagacaaatcaacttgattaaacaacgcattaatcccttttccgagcccgcctttagccattcgctgccacttcctttgctaaatctaaatatacttccgcacctctcgaacgcggatcgtataatatgatcggcttgccatgactcggcgcctcacttaaacggacattgcgagggataatggtttgatacactttatctctaaagtatttcttcacctcttctataacttgaataccgagattcgttctggcatcaagcatcgtcagaagcactccttctatcattaagtctgtatttaaatgtttttgcacaagccgaactgtatttaataattgactcaatccttcaagagcgtaatattcgcactgaaccgggataacaactgaatctgacgcggtaagcgcattaatcgttaataacccgagagacggaggacaatcaataatcatgtaatcgtaattttgtttcactgattctaatgctcttttcagcctgacctctcttgaaatcgtcggaaccaattcgatttccgctcccgcaagctggatcgtggctggaatgacatctaagttctctactgaagtcggtttgataatctctgttacatctgcgtcatctactaaaatatcgtacacacaatgatccacatcggctttttcaatccctaatccgctcgttgcgttgccctgcggatcaatatcaacaagaagaacccttttacctatgtaagctaagcaagcccccagattaacagaagtcgttgtcttcccgactccgcctttttggttcgtaattgctatgatttttcccacgatgtcacctaccttcacatgaacatgtactgtcttgtttctatcttatcaaaaaaagagtaaagcgttttatttttttcataatttgtttatcagcaagtgaaaaaaatgtaaacgaaaaagacactttcccttataagttctccgataaagtgacttttttgactgtgaaaagacaatatacgacgaaaaaatataaatttttacatttataatgtatggtgtacaataaatctatcattatcctaaaatagttttttgactaaaataaaaactcccctgctgatcaggagagtttttatttaggtatccgaatggtaagctgaatgtactcttcgaattcttcttcctcagtattcagtctgacgccgctgtcttccaccatggacaatgactggcgaatcgtattcattgcaattcgtgtatctcggctgaacgctttgcgtctcggctttggtttctgcttattctgttcaagcattttcaccactcggtcttccgtctgcttgacatttaagcttttctcaatgatttccgcaagcaaagtgacctgaagctccggctgtttgagcgggatcagggcccttgcatggcgttccgtgatttttttctccataatcgcatcctgaacgggttccggaagctttaacaatcggagcttgttcgcaatcgttgactggccctttcctaaacgctgcgccaaggcttcctgtgttaaatcatgaagttctaacagccttgcgtacgcatgagcttcctcaatggaggacaattcttccctctgcaggttttcaatcaaagcgacagatgccgtttccgtatcagagaaatcctttataattgcgggaatcttctcccattcaagcgtctgtaccgctctccagcgcctttcacccgcaatgagctcatattggccttcatcttctgtatgtctgacaacaatcggctgaatgatgccgtgtgtatggatcgtcattgctaactctttgatcttttcatctgagaaaatggtgcgtggctgaaaacggttgggaacgatagcatgtaccggtatctcgagtatctcttctttatttgtatcatgctcagctatctccggttcctcttccttctcaccaaacccgaagaaacgagagaatgaatgcttcatgtacctacaccacctttaaaaactgccatttttataattctattttctcatggtttttcctgctgtatcttcatcaattttgcagaaaatatgatggaattgtcacatcaggctgtctaaattacccttcaattggcgatttatttggagtacccggttttctcggatattttttcggagtgcttttcatcttgcgaattaacataatgttccgttcactttcttcaacgggaagtgtaaaggaatgaacttgttcaagctctcctcccaatactttaatcgccttttgtcccgctttcaattcttcatcagccgctgctgcttttagagcggcaaatacgccgtttttcttgaccagcggcagacaaagctcgctcagaacagacagacgcgccactgcacgggccgtcacgagatcaaagctttcccggacgtccttgcgctgtccgaacgtctctgccctgtcatggacaaatgtcgtatgctctaattgtaaagcatcagcgagattttccaaaaacgtaatccgcttattcagtgaatcgacgatggtgacatgcagatgcgggaagcagattttgatgggcaggcttggaaaaccggcaccggcgccgacgtcacaaagagtggtgaccttttcaaaatcaatataaaatgccgccgtaatcgaatcataaaaatgcttgagatatacttcctttttctcagtgatagacgtcagattcatcttttcgttccattccacgagcatctggtaatacaactcgaattgctccagctggcggtcagaaagggaaatccctttctccgctaaactggatgtaaattcctctatattcatgccgtcatcctttctattcagctaccttggcaatacggccctgctccaggtataccagcaggattgaaatatctgccggattgactccggaaatacgggacgcttgagcaactgataaaggacgcacttctttcagcttttggcgggcttcagttgcaattcctttaatggcgtcataatcaatccgatcagggatttttttgttttccattttcttcagcttctccacttgctgcaaggatttttcgatatatccttcatatttcacctgaatttccacttgttccgccacatcttgcggaaccggagaatcagcaggtgcaagttttgtcactgtttcatagttcatttccggacgtttcattaaatctgtgccgcgcactccgtctttcagctcgcttccgccgagtgaacggatatattcctgattttcaggagacggcttgataataacagaccagagacgttttttctcagcctcaatcgccgcttttttcttttcaaacgcttcatagcgctcatcagaaattaagccgatttcatggccgatttccgtcagacgaagatccgcattatcatggcggagcagcagtctgtattccgcgcgtgaagtcagcagacggtatggttcattggttcctttcgttaccaaatcatcgatcaatacaccgatatacgcatcggaacggctgaggatcacctcttcttttccaagcgctttgcggcctgcgttgattcccgccataattccttgtccggctgcttcttcataacctgatgtaccgttaatttgaccggccgtatacaggttaggaatttttttcgtctccagtgtaggccagagctgcgtcggtacgatcgcgtcatactcaatcgcatatccggctctcatcatttgcaccttttccagtcccggaatggtcgccagcatccgctgctgtacgtcctcaggaaggctcgtggataaaccttgaacgtatacttcctgcgtattcctgccttccggctcaaggaaaatctgatgacgcggtttatcattaaaccgaacgactttatcttcaatagaagggcaatatctcggccccgttcctttaatcataccggaatacattggcgaacgatgcagattgctgtcgatgatctcatgagtctcaggactcgtgtaagtcagccagcaaggcagctgatcggtaatgtattcaaccgtttcatatgagaaagcgcgcggaaccgggtcccccggctggatttctgttttgctgtaatcaatggaatcgcttgatacgcgaggaggggttcccgttttaaaacgaacgagatcaaaaccgagctcctctaagtgctcagaaagtttaatagacggctgctggttattcggaccgcttgagtaagacagatcaccaagaatgatccgccctcttaaatacgtccccgttgtcagtacgaccgttttcgccttatattcagcaccggtttgcgtaatgacaccgcggcactcgccgtcttcaatgattaaacgctcggcaatcccttgaagaagtgtcaaattcggtgttttttccagcgtatgcttcatttcatgctgatattggaatttatccgcctgcgctcgcagcgcccgtacggccggaccttttcctgtattcagcattctcatttgaatatgagttttatctatatttcttgccatttctccgccgagcgcgtcaatttcgcggacgacaatccctttcgcggggccgccgacagacggattacatggcataaacgcaaccatatcaagattaatcgtcaaaacaagcgttttagctccctggcgcgcggatgcgagcgcagcctcaacaccggcatgcccggcgccgatgacaatcacgtcgtattggcctgcttcataccccatggttttttcctcccttttatttacctaaacaaaattgtgaaaagagctgatcaattaagctttcgtggacggcatcaccgatgatttcgcccagcagctcccagcaccttgtcagatcaatttgcaccatatcaatcggaacatcctgctcaattccattcagtgcatcatcaatggcttgctttgcctgatgcagaatcgagatatgacgggtgttgctgacatatgtgagatctccgctttcgatcgctcctgtataaaatagcgactgaatcgcttcctctaaatcttgaatgccttcttctttcagcaatgaggtcgtgacgacgggcctgcctttcgcaagctctttgacgcgctcagcgtcaatcttagcctcgagatccgtcttattcataatgacaatgacgtccattccctcaaccgcttcaaataatttcacatcttcttcagaaagctcttcgctgtggttaagcacaagcaaaatgagatccgcttccttcagaacctggcgtgaccgttctacaccgattctttcgacgatgtcttcggtctcacggattccggcggtatcaacaagccggagcggcacgcctcggacattgacatattcctcaatcacatcacgcgtcgttcccggaatatcggttacgatcgccttcgtttcatggacaagactgttaagcaaagaggatttccctacgttcggacggccgatgatgacggtagacagtccctcgcgcaaaattttcccctgctcagacgtacggagcagcgcctcgatttctttcttcacgccgctcgccttctccactaagagctgatgcgtcatttcttcgacgtcatcatattccggataatctatattaacctcaacatgggcaagtgtttctaataattcatcacgtagacggcggacaagtgcggaaagccgtccttccatctgattcatggcgacattcatggcacggtccgttttggccctgatcagatccatcaccgcttccgcctgtgacaggtcaatccgtccgtttaaaaatgcgcgcttcgtaaactcaccgggttctgccagcctcgcgccttctcttaaagcaagctggagcacctgattaaccgtcacaatccctccgtgacagttgatttcgatgacatcttcccttgtgaatgttctgggcgctcttaaaacagacaccatcacttcctcaataatccgtcccgtagtgctgtctgcaatatgcccgtaatgaatggtatgcgattctgccgaactgagcgttttgcctttcggacccttgtacattttgtcggcaatttttacggcttccggcccgctcagccgaacgatcgcgatcgcgccttcacccatcggagttgaaatcgctgcaattgtatccatgctgttcacctctctttatctctgtttccatctatataaaaaattttatttacgccaaaattaaaagataacatagtttggtttgaagtggaagatacgttatccacaaaggcagaaattcatcccttattactttaacttatccacatgtgaataacaattaattttatttcctaaaaccttttttatcaacagcatacaccgaaaaagaaaaaacttaaacgccaaaagtatgattctgcttaggaatagagccaattttgccaataaaaaaaccgaagttccgattttacccggacttcggttttctgctatctttatgggaaataacgagatggcggtaccggccttcaccggtagaaaaagttttgatatttggatgcttcgccagagcgtcatggatgatttttctttcaccagacggcatcggttctaaatgcacatcttttttcgttttcgatacctgcttggccagcctgtttgccagctgatccagaatttctcttcttttcagacgataattctcagcgtcgacaacggcttggcggtactggccggagccgcggttcaacacaagctgcgtcaatgtttccagggcattgagtgtttgtcctctcttaccaatgagcagcgccgctttttcacccttaatatgaaaacaaactgtttttttgttttcctccgtgacaatctcggaaggcccggcaatggtattgatgatttcttccagatacgctttcgcttcctgaacggaattttttttctctttcagttctacgatcgcattcttttttccgaaaatacccaaaaaccctttatattcttcctgcaccaccgttatttctacttgatctttcgtcagttgaagttcctgaaggcctgattgaactgcttcttcgacattccgtcccgcagcagtcaccttcttcactttttctttcctcccgctttctgcgtttccggatcgtgtttaatgtccggtcctttaataaggaatgtctgagcaatcataaacaagtttccgactacccaataaagagaaagcgcgctcgggaagttgatcgcaaatacgatgatcatgatcggcataatccataccatcattgccatttgaggattctgagaaggatttccggccatcatcagcttctgctggacaaaagtggccacaccggcaacgataggaagaatatagtaaggatctttctcgcctaaatcaaaccataaaaagctatgctgtgaaatggcttgcgtacgcataatagcgtggtaaaatccgatcaaaatcggcatttgaatcaggatcgggaaacatcccgccagcgggtttaccccatgctttgaaaacagggccattgtttcctgctgaagcttctgctgcgttttttgatcttttgagctgtatttttctctaagcttctgcatttcgggctgcagcgcctgcatcgcttttgagcttcgaagctgtttgatcatcagcggcagaatcagcagacggattaaaatcgtaacgatgatgatcgataaaccatagttatcgcccgtcagtttcgctacgtacgtaatgacttctgacaatggatatacaacatatttgtcccagaaatgcggactattcgccgtaatcggctcttttacactcgagcatccggccagcagcacgagcataccgaccatactcagtagtaaccatattctccttttcaagaacgtttcctcctataccattctttataaaccttgtatgtattttagcatctttcagttttaaatggcggtcatttttcgccaaacaaaaggaagcgcttttaaaaacgtgaagaaaacaaaatatgagctatttcgacgaagatttcttatataaagaggtttttctgaataagtgctgcagactttttttcgtttcttcaatactgagttcagctgcgggttttctagcgataataataaaatctttcggcttgagaagctctttttcctcctggatcgcctgcctgattaaacgcttcacccggttgcgcacgacggcattgccgatttttttgctgacagaaagccctacccggagctctttctgctgcggctgatcaagggtatacagcacgaactggcggtttgccatagacgttccgcgtttaaacactttttgaaaatcttcatttttctttaaccgatttcgcttcttcactttgattcactccgatattcactcgcagaaacttttatttctatctaaaaaaaacgggccgccggaaaactgaagaaatttctccagttccgggcgacgcgtgatctcttttctcataatgtgaaaaaagaccactgacattattcagtggcctaagctgataatacttttctgcctttgcggcgacggcgtgctaatactagacgaccgttttttgaactcatacggcttctgaagccatgaactttactgcgtttacggttattcggttggaatgttcttttcatttatgacacctccctcgaggaatagctgttaaagacagtcttacttattatatttgtgctgcctattcattgtcaacttcagcagtgcttttatttcttacaaccataataggataacataccttaaccagtttagaaaccttaattttcatattcctttttttagcgcaaaaaaaaggccccggcctctgaaaaaaacggcatgtggataattttttggtcgttttttaatatccacaatcgttatcgacaacattttcacattgctaacccctgtggacaaagatttttcaacaagttgtcaggtttgtggataagattacgagaaccgttgcaagtcctcgcttaatttgatattatatttgtgttttaactcttaattacttatccagcctattctctttatccacaaagtgtggataagttgtggattgtttctacacagcttgtgtagattgttgtccacaacttgtggaatttgtcgaaaagctatttttctactatactatatgttttcaacatttcgtgtgtacgaatggtcagagccatatgctctttttttgtgttctataacagggaaagatcgctgattttaaaagaaaaggagggctgtgccggataatggagaatatattggatctttggaatcaagccttagctcaaattgagaaaaagctaagcaaaccgagcttcgaaacttggatgaagtcgacgaaagcccattcgctgcaaggagataccttaaccatcaccgctcccaatgaatttgccagagactggctggagtccaggtacttacacctcattgcagataccatatatgaattaaccggggaagaattgagcgtcaaatttgtcattcctcaaaatcaggatgaagaaaactttatgccgaaacctcaagtggaaaaagcggcaaaagaggaaccgtctgattttccccaaagcatgctcaacccgaaatatacattcgacacatttgtcatcggatcgggaaaccgattcgcccatgcagcatcactggctgtggcggaagcacccgctaaagcgtacaaccctttatttatttacgggggggtcggcttaggaaaaacccacttaatgcacgcaatcggccattatgtcattgatcataatccttcagccaaagtggtgtacctgtcttctgaaaaattcacaaatgaattcatcaactcaatccgcgacaataaagccgttgattttcgcaaccgctaccggaatgttgatgtacttttgatagatgatattcaatttttagccggaaaagaacaaacacaggaagagtttttccatacattcaacacgcttcacgaagaaagcaaacaaatcgtgatctcaagcgacagaccgccaaaagagattccgacccttgaagaccggctgcgttcgcggttcgaatggggactgattacggacatcaccccgccggatctggaaacgcggattgccatcctgagaaagaaagcgaaggcggaaggccttgatattccgaatgaagtcatgctttacatcgcgaatcagattgacagcaacatccgcgaactggaaggggcactaatccgggttgttgcctattcatctttaatcaataaagacattaatgcggatctggctgctgaagcattgaaagatattattccgtcttcaaagccgaaggtcattacgataaaagagattcagcggattgtcggacagcagttcaacattaagcttgaagatttcaaagcgaaaaagcgtacaaaatccgtcgcgtttccaagacagattgcgatgtatctttccagagaaatgacggattcttctttgcccaaaatcggggaagaatttggcgggagagaccatacaaccgtcattcacgctcatgaaaagatttcaaaactgctgattgatgacgagcagcttcagcagcaggtgaaagaaataaaagaacagcttaaataatagagccctcggatgaatcggggaaagtgtgaataacttttctatagccatgcacagtctgtccacatgtggataggctgtgtttcctgtctttttcacaacttatccacaaatccacaggccctactattactactgctattttttaaaatatattaattatattatccgttaggaggataaacatgaaatttacgattcaaaaagatcgtttagtcgaaagtgtacaagacgttctaaaagctgtttcatccagaacaacaattcccattcttaccggtattaagatcgtagcctcagatgaaggagtatcatttacaggaagcgactctgatatttcaatcgagtcattcattccaaaagaagaagatgataaggaaatcgtgacgatcgatcagccgggaagtatcgtgctgcaagcccgtttcttcagtgaaatcgttaaaaaacttccgatggcgactgttgaaatcgaagttcaaaatcaatatttaacgattatccgctccggaaaagccgaatttaatttaaacggccttgatgcagatgaatatcctcatcttccgcaaatcgaagagcatcatgccattcagattccgacggaccttttgaaaaacctaatccgtcaaaccgtgttcgctgtgtccgcctcagaaacacgccctatcttgacaggtgtaaactggaaagtggaaaacggtgaattattatgcactgccacggatagccatcgactcgctttaagaaaggcgaagcttgatattccggaagacagctcttataacgtcgtcatccccggaaaaagcttaaccgagctgagcaaaattcttgatgacagccaagaactggtagatatcgttattacagaaacgcaagttctgtttaaagcgaaaaacgtattgttcttctcaaggctgcttgacggaaattatccggacacgaccagcttaattccgcaggaaagcaaaacagaaatcgtcgtgaacacgaaggaatttttacaggcgatagaccgtgcttctttattggcgagagaaggccgcaacaacgttgtaaagctttctgccaaaccggcagactcgcttgagatttcatcaaactctccggaaatcgggaaagtagtcgaagctgtgctggctgaccagattgacggcgaggaattaaatatttcattcagtccaaaatatatgatggacgcactgaaagtacttgaaggagcggacatccgtatcagctttacgggagcgatgagaccgtttcttatccgtacgccgaatgatgaaaccatcgttcagctcatccttccggtcagaacgtattaaacaaacagaatgtgctgccggctaatgttcggcagcttttctgttcatcagccgctccctcaagcaagttttccctttccttatttcaggattttttagtacaattagatattagtgatatttgaaagaggtcgatattatggcaaatccgatttcgattgatacagaaatgattacgcttggccagtttttaaaattagccgatgtgattcagtccggcggcatggccaaatggtttctgagcgagcatgaggtgactgtcaacaatgaacctgacaatcgccgcggcagaaaactttatgttggagacgtggtcgcgattgaaggatttggttcatttcaagtcgtcaattaaagcgggtgacagcggttgtatatccaaaatttagaattaacatcctaccgtaattatgagcgcgctgagcttcaattcgaaaacaaggtgaatgtgatcatcggggaaaatgcccaaggcaaaaccaatctgatggaagccatctatgttctttcgatggcaaaatcgcaccgcacctcaaatgataaagaacttatacggtgggacgaagactatgctaaaatagaaggaagagtgatgaagcgcaacggggacatcccgatgcagctggtcatctccaaaaaaggtaaaaagggcaaagtcaatcatatagagcagcaaaaactcagtcagtatgtcggagcgctgaacaccattatgtttgcccccgaggacttaaatctcgttaaaggcagccctcaggtgaggaggagatttcttgatatggagatcgggcaggtatctgccgtttatctgtatgatttatctctttatcaaaaaatcctttcccagcggaatcattttctgaaacagctgcaaagccggaaacagactgaccggaccatgcttgacgttctcactgatcagctgattgaagcagccgcgaaagttgtcgccaaacgtctgcagtttacggcacagcttgaaaaatgggcgcagccgatccattccggcatttcccggggacttgaggaactgacgcttaagtatcacacggcgcttgatgtatcagatcccaaagatttgtcgaaaataggtaacagctaccaggagtctttttcgaaattaaaagaaaaagaaatagaacgaggcgtcacattattcgggccgcatcgggatgatgtccttttttatgtgaacggacgcgatgtgcagacttacggttcgcagggacagcagcgtacgacggctttgtctttgaagctggccgaaatagatttaattcatgaagaaatcggagaatatcccattttacttttggatgatgtactaagcgagctggatgattaccgccagtcccatttgcttcatacaatccaaggccgtgtgcagacatttgtcaccacgacgagtgtggatggcattgaccacgaaaccttacatcaagcaggaatgttccgtgtggaaaacggtgcgttagtgaagtgaagaaatgaggtgagcgattgtatattcatttaggtgacgactttgtcgtttcaacacgcgatatcgtcggcatttttgactgcaaggtcaatgtatcgccgatcgttgaagaatttctggacagacagaaagaaaaagtagtgccgtccgtaaatggcacaccaaagtctatcgtagtcacgactgagaatatatattactctcccttatcttccggcacactgaagaaacgtgcgcaatttatgttagaaatagattcttagcggatctttacaatgaatatatcgtttaagaaaagtgtaggtgaatgtgcatggctatggaacagcagcaaaatagttatgatgagaatcagatacaggtattagaaggtttggaagctgttcgaaagagaccggggatgtacatcggatcaactaacagcaaaggccttcaccatttggtatgggaaatcgtcgacaacagtattgacgaagccctggccggttattgtacagatattaacatcgagattgaaaaagataacagcattaccgttaaagacaacgggcgcggaattccggtcggtatccaagagaaaatgggccgtcctgcggttgaagtcatcatgaccgttcttcacgcaggcggaaaatttgacggaagcggatataaagtatccggcggtcttcacggtgttggggcgtctgtcgtaaacgccttatcgaccactcttgacgttacggttcatcgtgacgggaaaatccattatcaggcgtatgaacgcggtgtaccggtggccgatcttgaagtgatcggtgacactgataagaccggaacgattacgcacttcgttcccgatccggaaattttcaaagaaacaaccgtatacgactatgatctgctttcaaaccgtgtccgagaattggccttcctgacaaagggcgtcaacatcacgattgaagacaaacgtgaaggacaagaacggaaaaacgagtaccactacgaaggcggaatcaaaagctacgttgagtacttaaaccgttccaaagaagtcattcatgaagagccgatttatatcgaaggcgagaaagacggcataacggttgaagttgcattgcaatacaacgacagctatacaagcaacatttattctttcacgaataacatcaacacatacgaaggcggcacgcacgaagccggatttaaaaccggtttgacccgtgtcataaacgactatgcaagaagaaaagggattttcaaagaaaatgatccgaatctgagcggtgatgatgtgagagaagggctgactgccatcatttcaattaagcaccctgatccgcaattcgaagggcagacgaaaacgaagctcggcaactctgaagcgagaacgattactgatacgctgttttcttccgcactggaaacattccttcttgaaaatccggactcagcccgtaaaatcgttgaaaagggcttaatggccgcaagagcgcggatggcggcgaaaaaagcgcgggaattgacccggcgtaaaagcgcacttgagatttccaatttgccgggtaaactggcggactgttcttctaaagatccgagcatttccgagctgtatatcgtagagggtgactctgcgggcggatcagcgaaacagggacgggaccgtcatttccaagccattctgccgctgcggggtaagattctgaacgttgagaaagcaagacttgataagattctctcaaacaatgaggtcagatcaatgattacggctctcgggacaggaatcggagaagactttaatcttgaaaaagcgcgttatcataaagtggttatcatgacggatgccgatgttgacggcgcccacatcagaacgcttttattaacgttcttctacagatacatgcgggagattattgaaaacggctatgtctacattgctcagccgccgctttacaaagtgcagcagggaaaacgggtggaatacgcttataacgataagcagcttgatgagcttttaaaagagcttccgcaatcacccaagcccggcctccagcgttataaaggtctcggggaaatgaacgcgactcagctatgggaaacgacaatggacccggcgaccagaacgcttctgcaggtcaatcttgaagatgcgatggacgctgacgagacttttgaaatgctgatgggtgacaaagtagaaccgcgcagaaacttcatagaagcaaacgccagatacgtgaaaaaccttgatatttaaccatgaaagccttattttcgttaagaaataaggcttttttctcaaagctgcttcaaacagtctctgaaaacccgcaaaacccgtatattctactaaattaatgtgtataaacacaagtttattgatataatggagaatagtgaaatcgtattgaagatcataatggacaatctactcccacattatttcatgtgatacttcagggaggtttttttaatgagtgaacaaaacacaccacaagtacgtgaagtcaatatcagtcaggaaatgcggacatccttcctggactacgcaatgagcgttatcgtatcccgggcgcttccggatgtgcgtgacggtctgaagccggttcacagacggattttatacgcaatgaatgatttaggcatgaccagtgacaagccatataaaaaatctgcccgtatcgtcggtgaagttatcggtaagtaccacccgcacggtgattcagcggtttacgaatcaatggtcagaatggcgcaggattttaactaccgctacatgcttgttgacggacacggcaacttcggttcggtagacggcgactcagcggctgcgatgcgttatacagaagcgagaatgtcaaaaatcgcaatggaaattctgcgtgacattacgaaagacacgattgactatcaagacaactatgacggttcagaaagagaaccagccgtcatgccttcaagatttccgaatctgctcgtgaacggggctgccggtattgcggtcggaatggcgacaaacattcctccgcatcagcttggggaagtcattgacggcgtgcttgccgtaagtgaaaatccagagattacaatccaagagctgatggaatacatcccgggaccggattttccgacggccggccagattttaggccggagcggcatccgtaaggcatatgaatccggacggggatccattacgatccgggctaaggctgaaatcgaacagacatcatcaggaaaagaaagaattattgtcacggaacttccttatcaggtgaacaaggcgagattaattgaaaaaatcgcagatcttgtccgggacaaaaaaatcgaaggaattaccgatctgcgtgacgaatccgaccgtaacggaatgagagtcgtcattgagctccgccgtgacgccaatgctcacgtcattttgaataacctgtacaaacaaacggctctgcagacgtctttcggaatcaacctgctggcgctcgttgacggacagccgaaggtactgagcctgaaacaatgtctggagcattatcttgatcaccagaaggttgtcatccgacgcagaacggcttacgaacttcgtaaagctgaagcgagagctcacatcctggaagggttaagaattgctcttgatcatttagacgcggtgatttctctcatccgtaattctcagacggctgaaattgccagaacgggtttaatcgaacaattctcactgactgaaaaacaagcgcaagccattctggatatgcgtcttcagcgattaaccggtctggagcgcgaaaagattgaagaagaatatcaatcacttgttgcgcttatcgccgagctgaaagatattttagccaatgaagaaagagtgctcgaaatcatccgtgaagaactcaatgaaatcaaagagcggttcaatgatgagagacgcactgaaatcgtgacgtccggtcttgaaacaattgaagatgaagatctcatcgagagagaaaacatcgtcatcacgctgacccataacggctatgttaaacgcctcccagcgtccacataccgcagtcaaaaacgaggcggaaaaggcgtacagggaatgggtacgaatgaagatgacttcgtggaacacttaatttctacatcaacgcacgatacgattctgttcttctctaataaagggaaggtataccgttctaaagggtatgaaatccctgaatacggccgtacggcaaaaggtattccgattattaaccttctagaggttgaaaaaggcgaatggattaatgccattattccggtcagcacatttgatgaggagctttacctcttctttacgacaaaacaaggggtatcgaaacgtacggcactgtcccagtttgcgaatatacggaataacgggctgatcgctctgggtcttcgggaagacgatgaactgatggccgtccgcttgactgacggcaagaaacaaatcatcatcggaacgaagaacggtttgctgatccgtttcccggaagaagatgtaagacaaatgggacgcacagctgcaggtgttaaaggcatcacgctgacagacgatgatgtcgttgtaggcatggagattctcgaagaagactcccatgtcctcatagtgacagaaaacggctacggcaaacgtacaccggcttcagaatacagagtccaaagccggggcggaaaaggtcttaaaacatgtaaaattactgacagtaacggtccgctagtaacagttaaagccacaagaggcgaagaagacttaatgatcattacggcaagcggcgtgttaatcagaatggatattaatgatatctccactacgggacgcgtaacacaaggcgtccgtctgatccgcatgtctgatcaagagcacgtggccactgttgcgctcgtggaaaagaatgaagaagagccggaagaaaccgaagaagtataaacgaaaaagcgcagctgtaacaggctgcgcttttactatataaagaaataaaaaagctttgacacatagcgatgatgctgatataattctttttgttgtctttttaatagaaaggcaagcctagcgaaaatattttttgaaaaagtattgacctagcaaactgaaaatgttatgattaagaggtcgcttcgagaggagccagatccggttacgacaggcggaaaaaaggcgacgagcttgccgaagaaaaaagacagcagaatgactagcagacctgatgccaaaatgcttccgtaaatagctgaaatcccgtattccttaccgatggaaataatcggcgccaccgctgtgaacgtacagccgagcacaacgggcaagccgatgccgaaaaatttgtttctccacacttgaagcagcgtagccgccccgcacataaaaatgtcaattgaaacgagataagtcagctgttttgcgttcagccccagtgccgctcctacaattaagggaacgacaacagcgccggcatacatggcaagcacatgctgaataccgagggaaagtgttttggcatagccgtttttcatgaacggacctcctgtacaaatgtcacttttccgtcctcaagcgattgaattctcgccagtgattcgacccggcatccttttttcacgagctcatctcttcccggctgaaatgatttttcgataacgatgccgattccgctaactgctgcaccagcttgtttcacgatggacaaaagcccttctgccgcctgtccgttcgctaaaaagtcgtcaatgattaacacgcggtcttctttagataagtgactgccggagacggcaatctgactttctgtttttttcgtaaaagaatagacggacgccgtcagcagatcatccgttaacgtgagagacttcctttttctcgcaaagatgacgggaacaccgagctcaagaccggccatcaccgcaggggcaatgcccgaagattcaatcgtgacgatttttgtgataccgtctttttcgaaacggcgcgcaaattcttgaccaatctgctgcatgagaaccggatcaatttgatgatttaaaaaagaatcaactttcagcacttggtcagaaagaacgattccgtcttcttctatttttcgttttaatgcttccacaatgattacccccgcttatataaaataaaaaaagcattgcccgctctcaaaaaagagcaagcaatgccgaataatctacacgtaacggcgaatgaaagccgtcccattgctcactcatagtcggtcatttacggtgaccggtagaaacttgcgtgccatatccacgcgattatatgagtgttcgtatgatattaatcaaattataacaagatacagtccttttgcatagagaaatttgaatatttccgaacttttacaaagaatcagtttctattattcgtctttttggaatttttagaaaaacacccggcgtataccgggcgtttcgtttataaatataaatttgaatatttgccgacgagatactcaataagatattggacgttcagctcttctcccgttgcatctttaatgatgtctagcggcattttacgtcttccgtgctgatgaaccttttctgtcagccattgcttgatcggctcaaaatcgccccgttctattaattgatcaaattcaggcagatcgtcaagcatggtattcttcagctgagccgcatacatatatccgagcgcataggaagggaaataaccgaaatctccgcctgcccaatgaacgtcctgcaaaatgcctttcgcgtcagatggcggcgtaatgcctaaataatcatgatatttttgattccacaatgcaggcagttcttcaactgtcacttcattgctgaaaatcgctttttcaatttcataacggataataatatgaagcggatatgtcagctcatcggcttcaattcggataaaggacggtttcgcctcgttgacggcgcgtacaaaatcctctctttttacatcttgaaattgatcaggcgaagcctcaatcattttttcataatatgcggtccaaaaatgttgatttctggcgataaagttttcataaaataacgattgggattcatgaatgcccatggatgcaccgtcagataagttcgttccgctaagcgcttcgtcaatattctgctcgtagatcgcatgcccgcattcatgtatcgttccgaaaatcgcggtgcggaaatcgttctcgtcatatctggtcgtgacccgcacatcgccgcggttgattgtcgtcataaacggatgcaccgtctcgtccaggcggccgccgtcaaactcatatccgagctcttttaagaaatacaatgatagatctttttgtttttctttcggaaatgtttttgttataaaggaggtgtccggtttattgccggatgccgtcacttttttgacaagcggaataatcgcttccttcaattcagaaaacagctgatccagcacctttaccgtaacacccggttcgaaaatatcgagcaatgcgttatacgggtggtcttcataaccccaataagaaataaaccgcttattaaaatcaatcagcttctcaaggtaaggagcaaacatagaaaaatcagaagccgcccttgcctcctcccaagccgtttcagctttcgatgtcaaaatgacgtattctctatattcatcttcaggaatttttttattatgatcataatctttttttgcaagttccgccgctttcactgtatcttcaggcagctcttcggcatgcgcgagaaggatgtcaatcagctctttcatccggtcggatgtctggatttgaaaaacgtcagccgacagctgaccgatgctttccgcacggtcatcagagccttttttcggggctcccgttcttgagtcccaatgcataagcgcaatggcttcttcatagtgggatacccttttcagcagatcaaaaaattctttttcatatgtatgtaaatccataaccgttccctcccttttcactatcaattacaggctaatggaacgccgtgataaagtcaacttcccggatttaaaaaaagccgcaggatgaaaatcccgcagcatgtgtttttatacgattttcggtgtaacaggcaagacctttttgacttcggccagaacccgttcgctttctccgcccgcgtaaatggatatggttcctctgtcttgattagagcggataaggcggccgattccctgccggactctcagcagcatgtacggcagatcaacttcctcaaacgggtcttttttcgctccgttccgctttgcggtaaatacagggtcatgcggcggataaggcaacgcccaaatggtcacatttcggagtgagtcacccggaatgtcaagaccctcccataagtggacggaacaaagcactgattcttcatcccgctgaaatttttcgaccaggctgctgatctcttcgtcaccttcgtagtatatcggatacggcagttcccatgcggcagcctgttctttaaattccttcatatcttcaaaagaagggaaaagaacgagggtgcggccttcattctccttaatcgtttcaatggttctcgctgttttctgctcagacgtcatatcaccgtgaagcgtaacagacatttgctcctcgtagtcgtacggagattcaacggtaaatgataaaggatcgcggattccaagactgtctgcaatataatcaaatgaaccgccctcagaaagagtggctgatgagaaaatataagggatctttttagaaaagaccttttctcccagcacttcggctacagttctcggcatcacgacaaatgttgagtctgtatcctgcttttcaagccagctgatggcatccttttgatacagcgaaagtgaatatgccatttgttcgacgtattcttctacgactgacagctcgtacttatcaatcgtatacatttcggattcaaatacgagcgcctcgccgattttatcaagcagacggcacagttcgtcagctgcacgcttaacgcgctggtcgttttggatatccaatcggtgggagccggcgatttccttcgattcctctgacagcacatagaaaaactcatcatttgcggcaagggaatcttcaatcaattcggcaaattcctccctgatgtcattttgaagcaggcgctctaaaaacagctcaagcgtcgattgcttcacacgataggttaacgctttttgcgcggcgaattccagcagatgcccttcgtcaaacacgacggcgctgtgatccggcaaaagcggcagctgcccttcccttttgcgtgattcttctgtccatacatgttccatgtagaaatcatgggaacaaacaatcagatccgttgattttctgtaatgatctcttgaaagtgttaaaccgcatctatgtctcatatcacatgttaaacaatcctggaaggaatcatagcttacgcttgaccactcttcattcgtcaaatcagcgtactgcttgcggtcgccgtacggataaaagcgctgcatcgcttgtgattcatgcacgaatgaaggcagcgactcataaagatccagccacttttcatcatcagaacgctgcatcgttttctcaagctttttcagacacaggtactgctcatgggattttgacagccttgtatcaatctgtaaatccaaatgttctgtcagcttggaaatatcgccttcttttttgacaagctgttcaattaacgtttcatcggcgcatgcaataatggccggtttccccgtatatctggcatagctgatggcaaacagcagatacaccagcgttttccccgtaccgactcctgcctcagcgaacatgacctttttctctttaaatgcccgttcaagctgaaacgccataaatacctgctcatcccgaaggtcaaagcctttttcgggaaggatatcgtaaaacacgtcaccaatccaattgttcaattcttcgtaaaaattcttttcttttgttaaagcaaaaggcaaacgtgatgttgtcacccaactccaacccctaactattcggcattcagaccatctataatatcatttaacccttttcaatacaacaaaaaaacttggccgcgccaagtttttgtaattgttatttccgattaatgacatgtgaacataaaaacggatggtctgttgaatgtgtgtgttttaccgcattttcaagattttcctgtgcgtgtgtcacggcggaaggatctagctccgctccggcttcctgcagctgggacgcagttgcttctaacgccttttgtattttactgaagtactcactgttcagcataaaataagatcacctctcaaatagaaataatcatcattctatgccgatgcctcactttctatacatgccttcctgaatgatccgcacctgacctgcacaaactacaacagatattcgatcgaatatccatcttcacaaatttattctatccgggagtgatggttacatgagttataaagatcgattagatcagcattctgaattgtttcatcacaattggacgcggccgaaacgctctaaatcgcaagtgaacggccacaccgaaatgtcccagaccaacattattttacggagcaacgcaaaagcgcaccgctggtaatggcagaataaaacgtaaagatgttaaaaggctgtcgatattcgacagccttttaaaattatttctaatgaaattttttctgactattttcttttctccacataaatagttttagattgaactgcatctttcattttcccacctttgtataactcaacattaacctgccatctctctttaaatccaggttttagtagtttactaaaataaaacttcttaacaggtgttttattcgagaatgaacctttataggaaaaatcaccaatattgtattctccatctaaggtggtaacacccattcgatagttcaatgtcccacattttccatttgtctgagcatatacatcaatagaagtagcatttcttgtatacgttgttgcgtcagtccaaaccctagcttcacaacctttaattccatgaactgtttgccatgaactcatggctgcttctgctttaggactgcaaataaaagtagaccctgctatcagtaatgcagaagcacccatcaagattttcgatacttttttcattaattccaactccttcatatttttacataaaatattataaaacgatattatatatatatcaagactagtaggtaaattttaagaaattagtaaactaaagatacttataaaaaagcaaatccattaaggttttttctttattttgaggaaatttacagccaatttatgtatttactttattatccaacaatacctcacagatatttatatttaaaagtataataaatagccgaaaaacaagaacactagttcctgtttttcggctataacttgaaagacttattcataacctatttttaaaatcatgttgtcacaaaaattctgctataaaagggactatatttttgaaattgtttttttcttttttgcccaatactgataataatccgctttaataaaaccgttaaagagcttgcgtttttttgtcgcttttcttccgtaggcttcttcaaattgttcatttgacgtcagcatgtaaacagaccatgtatcaagagattcgaatgcccggcccatttctttatacatccgctcgacttcctttttttcgccgagccgttcgccgtacggagggtttccgacgattacgccgaattcgagtttcgtcgtgaaatcctgcacccgcatttgcttgcattcaatcagatccccgagccccgcttcttctgcattttctttggcgatgtttaccatccggtgatccacgtcacttgcaaaaatctgcagcggctgatcatagttcgccttttcttccacttcaagacgcgccttgtcccacagttcttttccgatccattcccagtcttctgagacgaaatcacgattaaatccgggagcaatgttttgcccgattaaggcggcttcaatcgctatcgtgccggaaccgcagaacggatcaacgaacggacggtcaggcgtccagttggttaacagaactaacgccgcagcgagcgtttctttaatcggagctccgccctgatcaaccctgtatccccgtttgtgaagacctgttcctgatgaatccagcgtgatgacggctttatctttcaaaagcgaaatctccactttgtactcgggacccgtttcttcaatccattcattttgttttcctgattgcagcttcagcttttccgctatcgcctttttgacgatgcgctggcagtcaggcacactggcaagtactgatttcacggactttccgattaccgggaactttgcgttttccggaatatatgcgcgccagtcaatcgcttttgttttttcaaacagctcatcaaacgtttttgcctgaaactcggcgacctgtactttaatgcggtcagccgtccgcagccataggttagcgcggcagatcgcaagcgcgtctccttcaaaaatgacttttccgttgtctactttgcattcatatcctaaatcacgcacttctttggcgacaatcgcttcaattcccatcggcgccgtcgctattagtgtgtacttcttcatcgtatcaccctgtctcttttcagctttcgtttcattcaagataaaagctcccctttaaaggagagctctaatttgtcatatcaataaatgtttaacgttctgtaagccatgttttgttccgtcgtactgcaatcggctcatcacctcgtactcaggcggcaatcatctatctacagaaagtattctgtccttctatccgttcagttccttcaagaaggttcccctaccaaaatttgggtttctcgctcgaggggtttaccgcgttccactctcatcatttctgatgagacttcgtcactgtggcactttcaaggatactcagccatatccgaagacgtaggcttttttcctgccgtcagcctatcaaggctgccctagcttatttcttcgctaggcacgaacactacgggcatctcagcaccgtgcgagcatggactttcctctacagattcaaagatctgcagcgattacccgaacgttaagaacacttgttcattataaagcaacttgtctcatttgacaagtgcatctgtcttattcgtcataaagcttgctgccgaatacatgtttctcaaggttggacagccttttcagaatatcaaagttggtcgtattggactgcaccggctgttttttgcttgcttcttcaagctgttttttcagctgcagattttcctgctgcagttcttcaatttcttgatggaaagtttcataatccttaataatcatatctaaaaatttgtcaacgtcttcttgtctgtaacctctaacacctgttttaaattctttttccaaaatgtctttcgcagaaagctttactttatcagcaagcatctttttcacctcgtatcgtgaatcatcatgttatattttattcagaaacacgtcccgttgtcaaatgttctctggcatgttatgtaaagaagtcttcttcttcaacggcagcccggagatcgtccatcgtaatcgaataaatcggataaccgtctttttcgcggcgtttttccgcctgctgcagcatatatttcggcgacccttccatctccggatcatataaaagcaaaagcgcgtctgacttttcaataaagaacgcgtttttctgccggaattgaagcgggctttcgtacggccgatgcgtcaggctctcctcataatctgcctgtgcaagcaccgattcatacatttctttattcggttccttccacttttcctcctggccgtagaacggcgtgataacggcaacctttaattccggatactcttctctgagatcgtacgccgtttctgccgcccaaagctccgtccccagctgtccggatatgagaatccattccaagccttcgtcaagaaagcttctgagtctggtttctatcgccttttttatataaataagcgcccggtcatcatgtttaaagataccgagttcaaacggcttgtaccccgttacggctaatactttcaattgatcacctgcttaaaaaatggggctccccatcgggccccattttgattgatatccttaccgactttgcttaagcgttcaatactaataatcgcagcaagggcttccgcactgaaaatgctggtgtgtcgtcggatcaacatttgaaaaagtatgcggatagtaatgaacgtgctcaaagttgtggtgatttacgttagttgtatgttgcggatgaatatgcggcacaactgtgttagtaaaacaatggtgttcacagcaattagtcggatggacaatcggcggcattacgtttgggcaacaatgatgatgatgatgatgaaacatgctaaatcccctctccattaacttttattacactgttaagttatgaagaaaagcgggtgcatgttctaattcaatcacccaatttagaaatgcatcagcaagctgtctttaaaattcgtaaatacaaacgcaatcaaaaaaaccacgacaaagaacaagtaaaaaacacctttatacataccaactctcccctataaataactaacgctattttacaggatgcggcaccattctacaacaaaatcgatgcggattcagaaaaaaatatttttggcgaaacagctcggcttttgcgctttcccgggcaatatttcaagaggaatatttcctcctcagccgggcaattctcacttggagtttctcggcttctttttccgatatttcatcgtcttttgcagccttttgcgcggcctgcagagcttttttgaaatcttttgcgtgatgctcaaaatagattgccagctctaccgctgattgatgtctgcatatgtgaagagcggagtccgtcagtttctcccaaaggggcactgcttcttgccttcggttttgttttttataaagcatcgctaagtcaaaaagggcccgatccgaatcttcaaagtctttgccttgcagcgcttccagctgcgaaacagcgcgatcggtttctttatgagcgataaaccacttcgccatggcgtacgcttcctgacgttctgacgtctgatcagaggaggcaaaaatcttttttgacatatgaatgtaaagagcgataagggagagcacatcttgttcattatgggagagcactccttccaggagagccgggtcctccgcctttaaaaattggaaatacagcattggagccaaatacccgggtgtatcttcatcccttttaaaggccagctcttcattttcaacagccgaaagcgatacacgctctaatttatgtttccaaagccgtctcgccccgtgcagaagatcaaagtggccgaattcaggaagtttcggaagcctgtcccgaagcaatgtgtgccttgtttttacctgcggccaatcaaaggctttgccgttatacgtcacaagggacgtaatatcaacctcactcaaaaagctttggtaaagagccgcctcgtttcccggcttgggaagcagatgctgttttactataacacggtcttcatatactctcgcatgaccgagcaaaaagatcatattgccggccccgccgccaagtccggtcgtttccgtatcaaagaaaaacagctggtttttttcgtatccttcggctgataaagtatgcgtcaaaccgcctttattccataacgccatgacgtcatcaagttcattgaagctataccgtccgtggcggtgcgaaagcggatagacggtttcacggataaggcagtattcatcctcaaagaagaaaggcttcactcccaatgcctcccaatcttctctaaacgggacttgaatatcaggcaccggaagcgaagaagctgccggctttttctcagtttccgggagattcaggtggtttttcatccgctttaatttatttttcaaggacatctctcgtcccccttttcttttacacgtaatttaagagccggagaatcgctttctttgcatcaattccctctatttcagagccgatgcaggaaggacatccgtcttgacatggacattgtctgatcagacgctcagccccttcattgatttcatcaaatcgtttgtatacttcatcagcaagtccgattccgcccggataatgatcatacagaaagattgtcggcaatcccgtatgagcggctttgatctgcggcacgacatgtacatcatttcggtcgcacatgacgtatacaggcacgatatgctgcaggacgtgagcaatgcctaaaaggagctgttcaagcgttttttcaccgatctccgaatccgtctcttttaattcaagccacgctgcactggtatgcagctcttcttcaggaagatgaatcggtcctgatcctatattttcaaatgtcgtcattttaatttttttaaatatcgtcggaagagcgtttactgtcacgtcaccgaaatgtatggccgttttccttctgctttctgatctgtcaatttccagcactttcagctgcaccgctaaattggcatccgtataatattcgacatcgacttttcgcacgtatgcttttttgtgctcccaatcaagcttttcaacctggtactgcactccttcatgaagataaatcgcttcatcatgaagaagcgtcatcgcgctgaatctgtccatttctccgataatttttacatcagccgtttctgaccgatcaacgatgaccacgttttcctgtgaggccgaacggagactgatgtttgaagcgggaaatgattcgctcgcccagtgatagcgttcacggttttcgtgaaggacgccttcttcctctaaatactcgagaatgtctcttgcatcattttctccgaatgtttcatcggctctgaaaggcagctcatacgcagcgcatttcagatgatcgaccagtataatgagattatcagggtttatccgtgcagattctggagagcgtttaaagaaataatcaggatggcgcacaatatattggtcaatcggatcagaattcgccaccattacaatcagcgcctctccctgccgccgtccggcccggcccgcctgctgccatgcgctcgcgacactgcccgggtatcccgtcatcacacagacctgaagctggccgatatcaacgccgagctccagtgcatttgtgctgacaacaccgagaatgctgccgtctcttaacccccgctctatttctcttctttctttcggaagatatccgccgcgatagcctctgacagacttcgcgccgatttctttttttacgatttcctgaatgtggcttaaaataatttcaacccggacacggcttcttgcaaaaacaatcgtctgaatcttatttttcaaaaacgttttggcaagttcgttcacttccacagtggcgctttttcgaatatgcagcggtttattcacaatcggagggttgtaaaaagcaaagtgctttcttccgctcggggcaccgttgtcgtcaatcagtttcacagaatttcccgtcagctgctccgccaattctctcggattggcgattgtggcggatgtgcagataaataacggcgtgcttccgtaaaaagcgcagattctcattaaacggcggatgacgttcgccacatggctgccgaatacgccgcggtacgtatgtaattcgtcaatgacgatatatttcaggttttcaaacagactcacccattttgtatggtgggggagaatcgctgaatgaagcatatcgggatttgtaatgacaatgtgtccggcttttctgaccttctgcctgatggccggagaggtatcgccgtcataagtgaagcttttgatgtccatgcccgtctcatctatgatttcgttcagctcgcttttttgatcctgcgcgagcgcctttgtcggaaataaataaagcgcgcggcttgaggaatcttccgcgatagactggagaaccggaagattatagcacaaagttttaccggaggccgtcggtgtgacggccacaatgctttctccggtttgaaccgtttgaaaagcggagtattgatgtgtaaacagccgctcgatccccctctttttgagagccgcccggattttcgggtttaccttatccggcattggcatggttttcgcctcccgcggctcctcttcatgccaatgcacaatattttcatgatcttttaattcctgaatcagttcgctcagtgattttttcttcatcgtccacacctctttatgaggtacagtttaccgaatatttgtttgcctggctagatgaaaatactgcacaagaaaaaaagcaggggaatagccccctgcctacttcatttttattgtaaaaagctctgtttgtccttttttcgcctcatttgcgcctgcaaattgcaaaggctctgcggcatcaccgttcataattaccatagggatgacggtgctgcttgctttttcttttattaaatccagattgcaggttaaaagcaggtcgcctgtcttgactttgtctccctcttttacatgggcttcaaaaccttcgccgttcatgtttacggtatctaaaccgacatgtatcaaaagttccgctccggaaagggtgcggatgccgacagcgtgttttgtatgaaacagctgaatcacttccccctcaaccggtgaaacaatgtctccgtttgcaggttcgacggcgatcccgtcccccatcattttttgtgaaaatacgggatccggcactgaagccaaatccatcaccgctccgtcagccggagaaaaaatcacttcctcggccggctttttccggctgtctcccaatccgaataattttttcagcaatgtgttgtgctcccttcctaaatctgaatccgttaccagtttattctccactatttaaccatactttcttttttccttcaattcttaaccatacgggataacatcgcatagtctgttgtaaaaaggcggtggtcatatggatcaaaatgaaaacgataaacgttatttagaaagaaatgaagacatcatcagccatgcgatggatcaattttttcaatcaggcaccttctcagaattgatgcagggctttcagcatcttgtcaattcggctttcactgaagcacaagtgacgattgacgtcagggaagagcctgcgggcctctcagttgacatcagcatccctcagacattccgtgacggggatatgctggtggaaacgaaagaacgctaccttcacgtgactattcggcatgatcataagcaggcgcattcatcccatatgtcttcaagcatgacaagaaccgttgtcctcccttatgaagtgcgtgaagaagatatggaaacatcctggaatgagcagacgcttaccctctttttccctaaaaaataagcatgaatgatatctatcattcatgctttttatttaaagatactggtaaatcctttcacaagcgatccgacctggtttacggcgcttaccatctgccctgtcgtatccatcattttattaaagtcaaactgtccgttcgtctttttaaactgagagagtatgcctgagaattgggaaggctgctgctgattcggtctgggaacggggtaaggattcacaaatcccggcggtcccccgggcatgcctgcctgaggaggagcgagattatacgtctgctgcatttgaccatattcctgatttggataaaattgcggcggaaactgcccttgctgatgatactgctgctgcaacggctgctgcaatggctgctgcaacggctgctgcaatggctgctgcaatggctgctgcaatggctgctgcaacggctgctgcaacggctgctgcaacggctgctgcaacggctgaatctgctgcggatagaaatagcccattggctgctgctggtacatattttgatatggctgcgctctccattgcatgtgacattccccctatacctctcactaagttttcttctatatatgtatgaattccgccttggttatgtgctttcggagagcctcatctttgtcaaatgctgtcgaaagtcttaattttttaaaaacagaaaaaagtcgaatcgttatgttaacataatctcaacatacatgagaggggatgcaccattatgaacgtatcatacttaagaaaacgttttgcagaagtgaaaaaatatgaaacagattgtgcagataaactgatggactttgcaaagtttctctatattcaaggccatctcacggcaaccgaatttcgaaacagtatgaaggttctcgaagcaagtggagcagaaaacccggcgtatgaataacatacccgccccctttatataaaagaaggcagctattttcagctgccttctttttcaatttcatcccttagtatacgaagcgtatataaaacagattcagttaaatccttgtatctttttttatgaatatgatgaacatatgattggagcatcagctctccgaaattttctgtaacggcctgaatttgtgcatgatgaacgtatttcggacggttttcctgaataaacgcaagcgctgcttcagtccaaaacgcgcaaagccggtcttttttttcaacgtcaggtttaatgatgtcaaaaaaatcatatgaacggccggtttcttttccttcctgatacctactttcggcttcaagagccgcctctatcatttgttctgtcagttccaataacgactgtgtctgcaaacggactcacctcagtacatatcgtaccaaagatttcgcacaaaatcagctaatccggcaggctctcggcaaatctttacgccggtcaggcaaaaacagatcatcaatacaaacatgaagctcgcgggcctcttcctcaaggcgggcaagccgttcctgcctgatttcttcagcttccgcctgacaggacttaactgccttggtaagtgtcttttcagcggcagaaatccggacttcgatatcagaaagcagacggagaatatcggccttactcgtgtaaacagacattcatgttcctcccttttatcacttgcgtctctccgaatataattctcgtttttataccgctctcctccgcacatgacaaaactagaaggagttcggcaaacaaacagagattatcctaaaaggcggacttttcgacaaaaaagtgccgcaaactttgtatgaaccggcacgttaatgcaaacgatacagttgaggaggtgccgtatgaaaacgagaccgaaaaatgcaggtaaacagcaaaaaaatgaagcaaaaacaactgatacgcttgataaaaaattaggcggcccaaaccgcccttccacgtaagacaccagagcccgaaaccgcagcgaacggtttcgggctttttcatttcgtcagccactcttttaccgcgaaaagcgcatggagctcacgtcttttctgtaaataccagtcggtcagttcaagctgttccggcattttctcctgtaaaaaagcccctttccataaccttttttgaaaccaatccgtttttttgccgtctaatgagtgggcaacaatgggataggttgtcctcagcatcggtgatgttctttttttgatgccgatcattttctccatatcaaagcgagagccggtatgaggaacggtatcaagaaatcggtaaaaagaagcgtgaagatcagggctgaacaaaagacgggcaagctgttttccgagcgtaattctttcttccgtttttgagaaccgtttgacggaaattccgtataaacatccgtcaaatgagggaaatatcaccgtattaaagtgaaaccaatcacttaaataaaaaggaatcgtgccaaaaacattctttttaaacgaaggattttgtataataggtgcttggatagtgttttgttcatttataataagagcatacatgagccgttccgtatctccgtcacgccaaaaacggagccattcttcctgcataaaagccgagacgcggaaataagggagatggcggaaaagaggttcgccgatttgttttgaccactggtagaccagaagctgaggataggcatcagaaaaaataagccaattcgccctttcatacgaaaggaaaaaccagtttttctgcctgctgtcaaggccctcctggtagagaatgcctcttaaatcagtcatcgaccagcccgcattgcgggacacaaaggatgccaaaagcgaccacttgatctcagggtggcggtcataatatgctttataggcattcgtccgggaaacgttatcggcattttttcttttcgtctctttttcaatctggcgaagaatggcggttacggtctgtcgtttatgcacgttcattcacttccgtcactattagtttgataaggaggatggaaaaagtgattcggtatccgaatggaaaaacttttcagccgaacaaaacggtttcatcccaaaacagccagaaacggtcccattcatacagtaatcgcggcatgaccctcgaagacgacctgaatgaaacgaatcaatattatctggctaaccaaattgctgtcattcacaaaaagccgacacccgtccagattgtaaacgtccattatccgaaaagaagcgccgcagttattaaggaagcttattttaagcagtcttcgacaaccgattacaacggaatttataaagggcgctacattgattttgaggcaaaagaaacaaaaaacaaaacggcatttcccctgcagaattttcatgatcatcagattgagcatatgaagcaggtagtcaggcaagacggcatttgttttgttattatatccgctttcgaaaaggtttatttcctcgaagctgacaagctgtttgtcttttgggaaagaaaggagaacaacggcagaaagtcaattcgcaaagacgaattagaagatgcttcctttccgatttcccttggatactcaccgagaattgattatattagtattattgaacagctttatttttcgcaggaacagtagactgagcgaaaggttgattaacgaaaggttgagatgttatgtcagatcaatttaagagccgtgaagaacgccgaaaggcaaggcagacgaaaagccccaagccttcttcaccgaaaaaaggcaagaaacagcgtaaaggcggtttattcaaaaagattgtactgtccttggttattctgtttgtcctcggcatagtcggcggagctgcggcatttgccgttttagtttccggtgcgccgtctttggacgaagccaagctgaaaacgccttactcttcaacaatttacgataaaaacggcaaagaaatcgcggaagtgggcggcgaaaaacgaacctacgtcccgattaaggatatacccgatgttgtgaaggaagcttttatcgcaacagaggacgcccgtttttataagcaccacggaatagacccgatccggatcggaggcgccttggtcgccaactttacggatggtttcggttcagaaggcggaagcacaatcacccagcaggttgtgaaaaactcgcttctgacccaccagaaaacgattaaacggaaagctcaggaagtatggctttcactgcagctggagcgccattattctaaagatgaaattttagaaatgtatttaaacaaaatttatttctcaccgcgcgcctacggcgtcggtaaagccgctgaagactttttcggcgtgaaagatttgagcaagcttacggttgaacaggcagcaacccttgccggaatgccgcaaagtccgaccggatacaacccggttaaaaatccgaaggcttctgaaaaacgccggaacatcgttctcagcttaatggaaaaacaaggatttatctcaaattctgaataccaaaaagcaaagaaagtgtccatgaaagatgaaggcgtcgtcagccaaaaggaatacgataaaaaggacacaaataaatacagcgcttttgtcgaagaagttatgaaagaaattgagacaaaagaaaagaaagacgtcgatatttcaactgacggattaaaaatttacacgactcttgatacgaaagcacaagattatcttgatcaattgatgaacggcgacacagtcggctttacccaaggcatgcagggcggcgtcaccctccttgatacgacaaacggagaaatccgcgccatcggagcaggacgaaacagaactgccgggggatttaactacgcgacagacactcaacgccagccaggttcaacgataaaaccgattcttgattacggtccggtcattgaaaataaaaaatggtcgacgtatgagcagattgatgactcagcctatacgtactctgacggcactccgattcatgactatgacaataaatacagacaaatgataacaatgcgagaggctctctcagactcacgtaatattcctgctctgaaggcattccaagcagcaggtaaagataatgccgtcgacttcgcaaacgacttaggactaggattaaacaaagacagtgtaacagaatcttattcgatcggcggttttggagctgataacccgggcgtttccccgctgactatggctggtgcctacagcgcttttggaaataacggaacgtacaatgaaccgcacgcggtcacatcgattgaatttaatgacggaactaagcttgatttaacaccgaaaccgaagagtgctatgagcgattacacggcattcatgattaccgatatgctaaaaacagtggtgcagtcaggaacgggtaaactggctcaagtaccgaacgtggaagtcgccggtaaaacgggtacgacaaactttactaaagaggatattcaaaaatataacattgctccaggcggagtaccggattcatggtttgtcggctacacccctcaatatacagcggcggtttggaccggtgttgagtctggtaacaaagcaggtaaaaaatcattatcttatgcagaccagcaagttgcaaaacggattttccaaaagctgatctcctatgttgatgacggtaaaggaagcttcaagcagcctgacagcgtcgtgaaagaaacagttgagaaaggctcgaaccccgccgctttagccggaccgaatacgccggatgataaaaaagtgacggagtacttcgtgaaaggaacggagcctactgccgtttctaaaacgtacaagaaagaaaaagccaataaaccgacaggcttgcaagtgaagtacgacaaagacaaaaaatcattaaacttaagctgggattatgatggtgatgcaacattcaatgtcaaacaatctgttgatggcggaagctacagcgacattcaaaacagttcggcaaaagaagccgtcgtctcagatgtcacccctgggtccacatacagcttccaggtgacagcggaaaatgatgacggaaagagcgatacggcatcagcatctttcaaagttccgaaagatgaagaagacaatgcagataaagataaagcgactgacgatgaacagaaacctgatgataaggataaagacaagacccaaaccgatgattcaaaaacggacgacaatcagacggatacgtcagacggatcggatcaaacacctactgatgacccgaataaaaatccggatcaatccaatcaggatcaaacggataataacaatccgaatcagcctggtaacgggacggataacaacggacagcaagataacagctctgacaatagttccgataccggttcagatggttcaaaaaatcctgacagcggccagaaggataaaaaccaagactcatcttcaactgtcaacggccagtcaaattcgtcaaccatccagtcaaataccgctaattagcgtgcgaaatccttcacctcaaacaggtgaaggattttttcatgcaaaaaaacctccttaagagaaaaggaggttttttataatttgttcatgacttcatatttatgatattgctttttcatctccgtcattaattcatccagctgaataaacgagtgaaattgagtcggttttgttaaaataaacgccattctctccgcccaattaatcggttccgcgggaaaatgctttgtttcaaggacagaccaatcgagtgatgtgacccgctcccctgccgtccaatgaaaagcggcaatcagacagacgatccctttcagcatgtcgttttgatcacatctcgatttccttgtttgaaaaacggggagcagcgcttctttcgtctcgttccaaatctgaaaaagaaacggaacatattcactcctttccctccatggctgcactttcggctggccgctgaaatccatatacagcggatggcggcgcagcaccgttttgatctcgaggttttccagatctgtaagactgcgcaggtatgtttcatagcctgccagaatgtcaatcgccgtcaccgtttcaccagtccttttttgtcacgcttctgcccttccctgcatagcgaaagcaaaggacattccgcacagcggggggattgcgctttacaatgatagcgcccgaaaaatattagtctgtgatgtgtgacagaccaatcctctttcggcacttttttcattaatgttttctctacttctaatacagagtccttccagcggcagatgccaagccgtttcgagacccgttccacatgagtgtctactgcaattgcaggtacaccgaaagcaacggacacgaccacatttgccgttttccgtccgacacccggcagcttcacaagctcatctcggtctttcggcacttctccgccgtactcttcgataatcattttgctcagcttttgaatattcttggctttatttcggtacagtccgattgatttaatatcctgctggagttcttccagcggtacggccaaataatcttcgggccgtttatatttttgaaatagcgtttttgtcactctgttgacgagagcatccgtacattgcgcagataaagcgactgccacaaccagttcgaaaggatttgaatggacaagttcacattctgcgtgcggaaacatatcgctgattttatcaagacaatattcaatctgctttaaatttaacacgtttctctccttctcatgttactgttccagccaattgtaaaaaggcacctgcctcgtatactctttttgcggttcattttgtttcgtttgaacgcgccggaatttttggctgtgcgccttcgcctgctcaaccgttttgaagccgttctttttccattcaaataaaatccggtcaatatagcgaaaactgagctttcctgataaaacagcttcttttaacgcatgtttaatcaaaatcgcatcatgctgatcctggtcctgccatatggccagcgtctcacattcaagcggagacagcggtcttccgaattcttcttcaaagatggtgtacaggcttttttgctctctttctgacgttctttcctgcgtttcgttttgtgaatgctgaatgtaatcatacagcttcgcccatagcggctgcagagaatatttttcgaactttatgccgttatgatcttcacattcttcaatgaacagaaagcctttttgaatgaacattctcagacagcttgtacattcttcagcagaaatggacatgcctgattgaagttcaaacggcgtcggaaaataagagcccttttccaaatgcattttaatcttcaaaagcaggatcaattcggtttcattcagcccgagctgccgataatgtgtcagcagcaggttagggatgcttgaaatgccgagttcctgcatatctataaattgctgttttttcatgcttacacctcttactgtaaaaggttatctccgggagctttcccctttacttagaaaaagtctcccttacaggagacttcgttttttataactattacggatacagacggttcagaagtcttgggaacggaatcgtttcacgcacgtgaggcgctccgctaatccaagccactgtccgctcaagtccgaggccgaagccggagtgcggaacagaaccgtattgtctgagttcagcataccatttgtacgcatctgaatccagaccgtgctcttttaatctttcttccaataaatccatatcatgaacgcgttctgaaccgccgatgatttccccgtagccttccggagcgatcaagtccgcacataacacgacatcgtcacgatctttagcaggctgcatataaaacggttttaatgacgtcggataatgagtgataaacaccggtttgtcatagctttccgcgatcgctgtttcatgcggcgcaccgaagtcatctccccattcaatatcgtcgaatcctttttctttcaggaattcgatcgctttatcatacgtaatgcgcgggaacggcgctttgatttgttcaagcttggacgtgtctctacctaatgtgttcagctcgatcttacaatttttcaggacgctttgtacgatataagcaacataattctcctgaacttcaaggttttcttcaaattcgacaaatgccatttcaggctcaatcatccagaattcgatgaggtggcgtttcgtttttgatttttccgctctgaatgtcggtccgaatgagaatacttttccaagcgccattgctgcagcttccatatacagctggccgctttgagacaagaaggcgtcttcatcaaaatatttcgtcgcgaacagctcagtcgtgccttcaggagcgcttcccgtcaaaatcggcggatcaactttcacgaagccttctttgttgaaaaattcgtaagtcgcacggatgatttcgttgcggattttcataatcgcatgctggcgtttcgaacggagccataaatgtctgtggtccattaagaattccgtgccgtgctctttaggtgtaatcggataatcagtcgcttcgtgaatgacttcaatggacgtaaccgcaagctcatagccaagcggtgaacgctcgtcttcttttacaatcccttttacgtaaagtgacgtctcctgcgtcactgattttgcgatttggaagatgttttcttcaacttcagctttgacgacaactccctgaatgaagcccgtaccgtctctcagctgtaaaaatgcgattttaccgcttgagcgtttattcgcgacccaagctccaatcgttacttcctcgcctgtgtgtttatacacttggttgattgttgttttcaaaatctttccctccagaacaagaaagacattcaggaatctgcctgaatctcttttttcatcactttattatacccgttctactcttacggggtcaatgcagatgaaaagcggcttcaaaagccgctttttcagaatcagctgtgtttttccgtaaagcggcggattctctcgaccgcttcttctaaaagatcaagtgacgttgcgtaagataagcggacgttgtctggtgaaccgaagcccgagcccggcacgatggcgaccttttcttcttccagaagcgccttcacgtattcatcgacatctttaaatccgcagttttctgctgccgctttggcgttagggaacaagtaaaacgccccttcaggcttgacacaggtaaatccgggaatttcactgagctgagcgtaaatcgtattcagtctgtgctcaaatgcctgcctcatctcttccagcggctcagccggcccgttgtatgccgcaatggcgccgtattgagcgatggacgtcggatttgatgtgctgtggctcgcaaggctcgtcatcgctttgataatcggctcggaaccggccgcataaccgattctccagcccgtcatgctgtgggatttcgacacgccgttaatgatgatcgtctgctctttcaatttatctgaaagctgtgcgattgagacgtgtttttttcctccgtatgtaagcttctcataaatctcgtcagaaacgatcagaatgtcatgctccaggcacacttttccgagttctgcaagctcttctttcgtatacatgacacctgtcgggttgctcggtgagttgataatgattgctttggttttctccgtgaccgcctgcttcagctgctccggtgaaattttaaactgattggactccaatccttcgatatagacgggacgccctcccgccaatttcacctgctctggatagcttacccagtaaggagtcggtataatcacttcatccccttcatcgagaatgacctgaaataacgtatacagggcgtgtttcgctccggtgcagacaatgatttcagacggttgatattcaattccctgatcatttttgaatttttcagcgatactgtctttcagcgccggcagaccgccagaaggcgtatatttcgtatgtccttcattcatggaacgcaccgcggcatctataatgtgctgaggcgtattaaaatccggttctcctgctcccaggccgatgacatcatggccttctgctttcagctgtttcgcttttgcggtaattgcaagtgttgcagacggtgttaatgcggatactctttttgccaatttcaacttgaactccccctaatacgtctcacggtgtgatgtttttgagaatcttgccgcttgtaaagtccacatagctaaaactatattgcccgtttttgttgatgtaggtcacttcccacagcaggacatcattttctctcgccaggtggacgtcattcagcttggaaacaagccctgcgtcctgaacgatcttggcagccttgccgcttgaaatgccgtcactggcttttttcgagagaatttttgcttttttgtcggccggaacccatacatacatgtcttttccttgtttatccgttccggaaacaacgtaatacttctgtttgccgacaaaggtttccactttctcagcatctgtcagattcgttttttctttagcggcagcggcagctgtttcgtggccttcttctttttgagccattgcagatttaaaaatgctggccgaaaataaaagaactgctaaaaaaataataccaaatacggctgtaaatattaatgctttttttctcatcttttttcacctatgtgcgataaatggtgaagaccgcttcattttgattttcttcgtcaagcgcaagtccgaacatcagattgtcccttttcaaagtccggtttaatgtatcgacgattttatataaatcatccgaatgctccacattaatcgtagaaagaatctcaattttgctttccatttttataccctccatcggtcgaacaaattttgttagtcataacgggatacacgcgcggcataataaaatcacaaggcggcatgaacccgcttttactatataaacaattcctcatcccacaccacgaaagccgcgtttatgcggcttttattccgtttggctgacgtaatctgcgagttcgtcatccgtcagttccaaaagggatgacgtcgggagcgcttcaagaaacagccgtccgtacccagccgtcttgacacgctgatctaacagaacgatcgttcctttgtctcccgccgtacggagcaggcgcccgattccctgtctgaacgttaatacggcctcaggcagagaaatggtctgaaacgggtttttcccctgcttcttagcgtattcgcattttgcggcatgaagcgggttatcaggcgcccggaaaggaagccttgcgatcatgacggttgacaattcatctcccggaaaatcaacgccttcccagaaatgattcgtcccgagcaaaatcgcccggctggccgttttaaaggttttcattaatttaccgggactcccgcccgagatgccttggccaagaagctgaatgcctgagatctccatactgagtttcaattcctgatacacttttttcagcatatcatgagatgtaaacaggataaggatcttcggctgttttccctttgacatgatttctgcatacttagcaatatgctcaatgacttcccgctctccgtcatatttgacggatttcatttctttcggaatgatgacgttcatctgatcatcataagaaaaaggagacgggatgcttttggtgcgcggataaaagtccgaaagtcccagcctttcaatcataaattgaaaagactgctccaccattaaggtcgctgatgtgagcacaacgctttttttgcgggcgaaaaactggtccgccagcatttcaccgggctccaggggctgtgcatagatgctgacggcgttttttgcgcctttcgcatcaatttcaacccaaacggcctctttctcatcattttcaaacagcagccggctgaacgtatcacggtattctctcagccctctgatacactttacatattcggccgctaaaaaagccgctccgcttttcatctcatcaagcttttgatgtaacattttctcctgtacggaaaacaagtcgagcagctgatcaagcatcgcacaaagccgctccgctccgtccgttatcatgaaaagccctttatcctggcttttatgattcagactatagacgagacggttcagatcgtctttaggttttcttcgtttgacaaaagaatgcactgaactgaaaaatgcgtcgctttcagattgaatatgcttcatccactcatcggcgtcaaaaaaactttccgccggcaaatcatacgtataaaacagttttgtcatccgctttaacagcccgtgttccttcaacgttccgattcggctgagctttgtgtgcaacccgatgtatgaagctctgcgtcctaaatgctcgctggcggcgcgttcgaaatgatgcgcttcatcaatgatgaccgttccgcttgcaggcagtttttttgtttcactgctttgatctgaaaacagcaaagcatggtttgtgataatcagatctgcggcctgcgctttttctttagcccgttcataaaatccggcggccgattccttcccttttttcaaaaaagaatcctcatcataagacatgcgctcccacagcaatctcccgcccgaaggaagattcagctcagctgagtcgcccgtttcagtctccgtcagccagatgagaagctgcgccttcgtcagaaccgcatcatagttgtcatcttcctcatgcagaatatgttcaaacttgcgcaagcacagataatgcgattttccttttaaaatagcggcctgaaccggccaaggaaacatacactccaaaagcggaagatctttagacatgatctgctgctgcaaaagagtagagtacgtgctgataatgacgggagtttgttccgctttggcaaataaaacagccggaacgagataaccgatcgtttttccgatgccgggcgccgcttcaataagcgcatgctcccgattgcggaaggcaccaaggacttcatccatcatcgaaagctgcccttcccgcctttcatagcgggggatgatgtcagataagagccgttctttttcttcgttccatttttcaaggtcaatggcagcgctcaccggccgggatgccgggatttgttcgggctctttaattgaaaaagaggcatatggaatgcagctctcttctgccgccggcctgttttcatgaataaaagaatccaaaagcagcgtcaaatcgctgataaaatgctgtgaaagccttctaagctgctttaacgtcggcaaaggcagatgtttcagtttatgtaaaatgtctaaaaagatcagtcccgtaacctccgcatcactgtctgcgcggtgaggccggtcatgaacaatattcagctccgcgcacaattcaccgagcttatacccttcaaatcccgggaaaacaatacgcgagagctcaaccgtatcaagcacttcgcaatccgtcagctcataacccgcttcgctcagttcatgccggacaaatccgaggtcaaaatgaatattgtgcgcaacaaaatacgcgccgtcaagcagatgaaaaatctcttctgcgaccgcttcaaacggcagttcattttcaaccataccggttgaaattccggtcagctgttcaataaacggcgggatgtcctgattcggattgatatattttgaaaaccgctcagttatttgtccattttcaatgacaaccgctgcgatttgaatgattttatcgccctttttcggcgaatttcctgttgtttcgacatctatgacaacgaaccgttgcttgttcattaaaatggacacctcaattcttgcatacgagaaaagtgtaacacgttttgttcagaaatggagcggaaaaacagcttttgcccctaaatcttaaaagaaaacccccatgaagggggctcttttacaaaatcgtgtgcgccggctcctggcccagcatctgctcgattttattctgatcatcaagcaccgccaccttcggctgatgggtttttgcttcctgatcagacatcatttgataagaaataataataactttatctccctcttggacgagacgggcggcggctccgtttaaacagatgacgccgctcccccgtttaccgggaataatatacgtttcaagtctcgctccgttgttattatttacaatttgaactttttcattaacgagcattccgacggcatccaaaagatcttcgtcaatcgtaatgctgccgacatagtttaaattggcttccgtcacggtagcgcggtgcagttttccggccatcatagtacggtacatattatgatctctcccattcatcaatatcaataatgatattatcaatcagtcttgctttagaaaattgaacggcgcaggccagaatgatcttcccgtttaacgtttcaagcggagtcagctccggataagcgtacaattcggcataatcaatgacgccgcttgtgttttcgatgatgccggtgacggcttttatgacgttttccgggtttctttcaccgtctctgatcagctcggcgccttgttgcagcgctttatagatcatcggcgcttcttttcgttcctgctcagtcagatagacgttgcgagagcttttagcaagcccgtcttcttctctgaccgtgtccaccgcaaccaattcgatatccataaagaaatcctcaatcaatccgtccacaactgctgcctgctgggcatctttcaggccgaagtaggcgcgggtcggtttaacgagattgaaaaacttcgtcaaaacagtagccactccgtcaaaatggccgatgcgggaggcgccgcataacacgtcagttcttctttttacatgcacggcaacattttgctcacccttatacatgtcactggcagacggcgtaaacaatacatctgcccccgcctgttccgcaagccgggcatcgcggtttaaatcacgcggatatgcttcaaaatcctcgcccggtccgaattgagtcggattgacaaagatgctcatcacgacaatatcgttttctttggtcgctttttcaaccagcgtcagatgcccttcatgaagaaaacccatcgtcggtacgaatccgatcgtccggccttctgagcggtattgtgcaatcagttctttcagctgttgaatttctgtcacttgtttcatcgcttactttcctccgtacaagccttgcagcacagtttgattcagctgaaaggagtgcttttcttccgggaaaacccgttctttcacgtcacggacgtaaccgctgagcgcggactcaatcgtcccgtcgattttggcgtattgcttcacgaacttcggtgttctgtccacgccgtggccgacgacgtcatgataaacaaggacttggccgtccgcttttgaaccggctccgattccgataacgggaatggatacttcttcttttattttagctgtcagttcagcaggcacacattcaaggaccagcatcatcgctccagcctgttcgcatttgatgctgtcttcaatgagctttttcgcgctttgctcatcttttccctgtaccttatatccgcctaatactccgacagactgcggtgtaagccctaaatggctgacaacaggaatgccgccgagagtcagcgcgcggatggattcaaaaacgccgtctccgccttcaagctttaacgcgtcagcgccgctttcctgaataatggccgcggcgtttttcaatgtatcctcttttgaaaggtggtaagacataaacggcatatcagttacgataaacgtatttttcgcaccgcgtttgaccgcttttgtatgatgaatcatgtcactgaccgttacaccgacggttgaatcgagcccgagcacgaccattccgagcgaatccccgaccaaaatcatgtcgactccagcctgttccgcgagcttggcctgcggataatcgtaagcggtcagcatcacgatcggctcttcgttttccttcattttcataaaatccagttttgttttcattctgattctcctcctctaaacggtgaggagatgagccgccaattctttgcaagcaaaaaagccttctgtaaaataagaaggattcccacttgtttaacgttcggcgaatgtcatccctctgtcccagtccttttttggatcaaggcagacttttcgtagtctctgttctgctgatcaggtgcagttcattatgatactgcccataggaagtataccaaattcgcgagacttgtaccaactaagattaattgagctcaatatcagcagaatatattttctttatgccgtctttcgtttccaagagaagaactccttcatcatcaatgccgagcgattttccgtaaaacgtcccttgcagcgttctcgctctgagctcgttccccagtccgactgcgtaactttcccataacagcttgatcggtgtaaagccgtgctttaaataatcctgatagcgtttttcaaaagtcagcagaatctcttgtatcagacccgctctgtcaatttttccgccggcctccaggctgagacttgtcgcaatttcctgaagctcgccgggaaaatcggtttcctgctggttcacattgataccgatcccgagaataaccgaacggacacggtcttcttccgcttgaagctcagttaaaatcccgacggcctttttaccgtgaatcattaagtcattcggccatttaatggcgggctgtacaccggtaaaggcctcaatagcctgtacgaccgcaacggcagataacagggtaagctgcggcgttttttgcaacggaacgtccggtctcagaatgaggctcatccatatcccgtttccttcctgtgaatgccacactctggacattcttcctctgcctgccgtttgtttatcggcgactacgagcgtcccttccggcgcaccgtcattggcaagttcatgggccgttttttgggtggacggcaggacgtcccggtaatacagctgtttgcccaaaacctctgttttcagcccgaaacggatttcggattcactgagttttcccggctttttgatgagcctgtaccctttccgcctgaccgcctcaacctcatagccctctttgcggagctcttctatatgtttccaaacggcagttctcgaacagccgagcgcgtcacttattttctgcccggagataaagccgtcgcccgcctcagaaaataaatcaattaattgggttcttaatgttgatcccatgatgcgagccactcctttatgtcatgttttcggttggggagctttcctgctaataccgcttcttcaatccggctcagttcttcggccacccatttacccgcgcggcggtttctgaactccatcagatcagcgcctgaaatgtcgaggtcacggagacttttgatcggcagctgctcatagaggctctgaacctctttcagcttttgttcatcaatcgtcttatgctttttcagcattccgattttaacagctgaaaacagcgcctctcccgcccggtacatcgcttctgcttccagctgcgccggatacacgcttatgatccgcaccgctccttttatgacttttcccggcagtttccattgttttaaaaacggctcggcgtttttcggactaagaccgagaaataataacagcgctgcccagcgttcttcgcgcgcatccaaggaagaaaacgaaaattcacttgcttcgagcatttgctgctcataaccggaaagaccgggcagctcctgtatcagacccgtctgcaccatcgtttgaatcgcttcatttgaggatgtgccaaggagaagcttttcaaactcgacggtctttcgttctactgatacgtgcgccaaaagctccctgtcttttatgacggccttttttgttttttcctctaacacaaagccgagctggctcataaaacggacggctctcatcatccgcagagcgtcttcccgaaaacggtcttcagggtttcccaccgtacggatcagctttttcccgatatcgtgagcgcctccgaaataatcaagcagctctccttcggcagacatcgccatcgcattaatcgttaagtctctccgctttaagtcttctgataaagaagtaatgaaccgtacagcttcagggcgccgataatccttatattctgattcggcacggaaggtggtaacttcataggtttcatctttccataagacaattacggtgccgtgttcctttcctacatcgacggtccgctcaaagaggcgctccacctcattcggcgaagcgctggtcgcgatgtccacatcacctatttttcgtttcatatagctgtctctgacggctcccccgacaaagtacgcctgatggccagccttcatcagatggtgaagaatggggagggctttgacaaattcctgttccataaaatcactccggtcctgccaattcgtcataaatccgttcatattgactgacgattctttgcgaagaaaaggcggtctccaccattttgagcgcatggtcagtcaaacgtttgctgagctgtttgtcttctaaaatcgcaagcgctttttcagaagccgcctgaatatcgccgacttccaccagaaaaccgcttacttgatctttaatcacttccggtatcccgccgatattagttccgatgcacggcacgccgcaggccatcgcctcaaggagaacgagtccgaaactttctttttcagacagaagaagcttaaggtcgctgatggaatacagctcttccaccctgtcctgatttcctaggagcagcacttgatcctgcagaccgtatttctcgacaagctgccaagcgacgcacttttccggtccatcgccgacaagcagaagctttgcctttgttttagctgcaatattacggaaaacacggatgacatccttcacgcgttttaccttcctgaagtttgaaacatgaatgacgactttctcatccggcaaaataccgtgtttctcttttatactctctgtatttttcttaagataaacacgttcatcaataaagttgtaaatggtctcaatttttttattcggcttaattaagtcatatgtttcaccggcaagcgcggttgataccgccgtcactctatcggacgattcgatggcaaaacggattaaatcttttagtgacggatcatatcctaaaacggtgatgtccgtaccgtgaagcgtcgtaacgatcccgatgtcgcgcttgagcatctgtttggcgagataagcgcataccgcatgcggcagcgcgtagtgcgcgtggatgatatcaaggttttcccttgcggcaacctcggcgattttgctcgccagcgaaaggtcatacggcggatatttaaataccgcgtattggttgacctccacttcatgaaaatgaatattcggatgatatgtatttaatctgaacgggatgcttgatgtaatgaaatgaacctggtgccctttttccgcaagcagcttgccgagttccgtcgcaataatacccgagcctccgacactcgggtagcatgtaatccctatttttaatggtctcattgtccgcccccaaaaacatcatcattcaaaacgggaagctgttttgaaaagaaaccttcggcgtaccccgtcccggcttctttgccatacagtctttcccgcgcttccaccatttcgatataaccgtttgtcagcggtgtgttcactgactgcgccgtagaaataaactggctttgataggcattcaggctttcctttttcagatcgatggtttccgttatgtcgattacaaagtccggacggtgaaatccattgatcatataatagtatactttctgagctttgtgagccggaagttgctgatggtctttgtatttatgaattcccgctgagaacaccgcctcttcgaccaatgccgcagcattgccgtggtctgggtggcggtctttcggataaggcatgaaaacggctttcggccggcaggctctgatgacactgacaatcctgcaaatggcatcttcacttttcaaaagcccgcggtcgggaagcgtaagctggattctctcttttacgccgagaattcgggccgcctccgccgcttcttcttttcttatacttaccgtcccgttagatgataattcagcctcggtcaggtcgcatatcaccgcggtttttccttgtgccgtaaattttgcgatcgtgccgcccataccgatctcgacatcatcgctatgagcgccgaacgcaagaatatcaacgtgttcaggcattcggctctcctccgcgcacaagattgcggaaatcaaacgccccgccgtccagcgtacggacgaggatttccgctgttcccatatttgtggcgagcgggatcgcgtatacgtcacacagccggatcagcgccgagacatccggttcatgaggctgcgcagttaacgggtcgcgcagaaaaatgacgagatccaaggcatttgccgcaattaatgcgccgatttgctgatctccgccgagcgggccggattgaaaacgttcaatggacaatccggtcgcttcctggattttcaagcctgtcgtacccgtcgcgtataactcatgatggctcaatatatctttatatgcggtcgtaaactgaaccatatcctgcttttttttatcgtgagcaattaaagcgattttcatttgatgttctcccccttgccgattcagtcgataatattttcgagtccgtatacaagctggtcgattttcatcacttgctctactgacagcttcactcctgacataaaggaagcccggttataggagtcgtggcgcagcttcagcgtctggccgtccatgccgaacatgacttcctgatgggcgataaggcccgggagacgcacactgtgaaggcggattccgtttaattcggcaccgcgggcgcccggcagaatttctttttcatctggatgaccctgctgcttttctgaacggacatttgagatcatttccgcagttttcagcgccgttccgctcggtgcatccagtttttgatcatgatggagctcaatgatctctacatcttcaaaatagttggcggccatttgtgagaatttcatcatcagcaccgcgcctaacgcaaaattcggggcgatgatagcgccgatccctttttcttcggtgagagcgtgaagttcctgtaaatccgcttcagaaaatccagtcgttcccacaacagggcgaacgccgtgttcaagagcggctttcgtatgttttttgccgatttcaggcgttgtcaaatcgatcagcacatccggttttgtttcctggaaacatgcgcggatatccgtatagataagagcgtctgaatcagctgacatcacttcccgcaatgtttgctgatcgtatgtatggtcaatggcgccgacaagctcaaaatgaggcgtgcggacagcaagttttacggcctcctggcccattctgcctctcggtccggcaatgacgactttaatggtttcatttgacatggtttctcctactttccttcttcttttctcgtccagcggtctttatcccgtgtattaaatttatgcatcacgcggttatgagcttcctccaatgaaatatcaagggagttggcgaggcagatcaggacgaacagcacgtcgcccatttcctcttccatgcttttctcattttccgtcgttttcttcggcttttccccatagtaatggttgacttctcttgcgagttcgcccagttcttcggtgagacgggccatcatggcaagcgggctgaaatagccttctttgaattggccgatatattcatcgacctcagcttgtaagtctttcatcgttttgtcactcactgtgcgaatacctcctgtcatctcttccatgttagctaattcaagtacatttgacaaatgttaaaaacggcagtttgctgttttcttttgtatccactataatatttacgcaatctaatggaaggaaaaggggtttgatgcaatgcttggagaaatcagaatcaaaaatatttgctttattttaatcggcgccgctgttttttcattcggactggttcactttaatatgcagaacaatttggcggaaggcggatttaccggcattacgctgctcttatatgcgttattccacatcagcccttctatttccaacctggtattaaacattcctatctttttcatcggctggcgcatgctcggccggacgatgtttgtctataccctgatcggcaccgtctctctttccgtttttctgagtatttttcagcgttacgaaattcatatgccgctgtcgcatgatttagctctggcggccttgttcgcgggtgtatttatcggcgcgggtctcggcattatttttaaatacggaggcacgacgggcggagtcgatatcatcgccaggctgatcaataaatttttcggcatcccgatgggccggacgatgtttgcctttgatgcctgcgtcattctgctttctttgtttacgtatctttcttacaaggaagcgatgtacacgcttgtagccgtttttgtcgctgcgagattgattgattttatacaggaaggcggttatgcggcaaaaggcgcaacgattatttcttcgaagaacgatttgatccagcaaaagatcattgaagagatggagcgcggcgtcaccgttttaaaaggacaaggatcatatacaaaggaagacagagacgttctttactgcgtcgttccgaaaaacgaaattgtgcttttgaaaagcgtcattacttctgttgacccgcatgcttttgttgctgtaagcgatgtccatgatgtgctcggcgaaggatttacgcttgatgaaaataaaaatccgatcagacgataataaaaaggcggctcttgccgcctactcctcgtgtttccatttgacaaccggtgattttttctttctcaaccggcgggcgaatgccgggctgacattgagcgtctgctcgacaaagcgctgcggcgtcagcgccagccattggtttaaggagatgtcctcgaaacggtcgcttttgaaaatttccagaaagcgaagcacggtgtcaccggtattctggacataatgacccatcgcaaaaggaacatatcctacgtcacccgcttgatagttaaatgtccgcgctcttccctccgccgcaaacaccgtcatttttgcttctcctgaaagataatactgccactcgtccgtattcggatgccaatgcaattccctcatgcctccgggctcgacttccacaagagcggcggcaatcgtttttgacaccttaaacgtttttgaatcgacgatctttacttttcctccgctggtaacaagaggttcctgcagtgaaagcttgtagctgaacggttccaaaacggtgccttccggggaagaaactgctgcctgttcaatagggggaggcggttccagctggaacatgtaacgctcttttgcagggatgtaagccaaatcatatcccgaaacaccgaaattcgcctgcagcacgctgcgcggagtatgagcaaaccagtccgttactgaaaaggtgctgttctctgaaaaagagccgtcatcaaagacaagcaaaaactcactgccctgctccattccttgaatggagtgaggaatgcccgaaggaaagtaccacagatcgccctcactgacgttatcaataaaattccgcccattttggtcgaccgcggttaaacggacttctccgcttatcacatatccccattcggcttctttatgccaatgaagctcccgcaccgctcccggtttcagtctcatgttcaccgccgcgatgtttttggacaccggcagttctctgaccgtcacctctcttgaccatccgccgtcttcaagcctcatatgcgtatcagaaaaagagaattttaagttttgaaccgttcctgcatccgttgagggcggaacgagcatgtcaggattctggaagtcacgagcgaggtttcgcggtccttcatcagtcgccccttttctgcctctgatcggctgcgggaggtgttttgaagccaattgctggatgagttttttcaccttctttagctcctttacagcaatttgtgtttatttagacttaggatattcacgctttttctctttctttttttccgctctgtattttcggtagccgacatatgtcagcgcagtaataatgataccgcctgttgtcagaatgacccagagcagcgaaggatcagcgtcatcccgttctaccttgtcaaataccttttttaaatccttctggagaagcgtcagccgttcaagctttgttccttttgtcatctgctgaaacccttcctgctcaatcacctcgatatgtttcgccaccgtatcaagctggccggccgacacatccattgtcaggctgggataaattaaatcatataatgatataaattcattccacttttcattgaaattctcacttccgttcccgctgacatcttcttttaaggcgctgaatgtagccataatcggtcgttcaagcgaaccccacagcggatcggagtgatcttccatcgcatccattaccagcctgaactgggcggctgcccgtattttttcggtatttgaggcatctgcctgtttcaagacccgcactaaatcattgtagcccagagtcacctgcctgacttcggcgccggtcagtgagtttacgtgtgtcatttttttcttaaagtagccaagcacttgcagggcctcatcatactgcgaatgccgcgtcatttggaaaacggtatccgaaaggtcgttcagttccttgagacccccctcaccttcagctttggcagttgtgatgaaacacataagagcaagcaaaagacagatcgtcagctttcgtttcatagaggtccctcccactccttctcttttacagaatatgaggagcgggacaaggttagaccaagattctatcagtgtaagtcaagctttatccgccttttggaaatcaccaaaaagtatgcaagaccgagagaacaaatgctcagccagaatgtggcatagccgatctcttgcatataggcactaagcattgagtagcggggcatcatgccgaaaagataatcaatgacgtcattatgaagcgtccaaacagcggcaaggatgagatgccataaccggaaccgaaaatacgggctgtataaaacgccttgaacggccatggcgaaatgtgaagcaatcagcatgtacccttcccaaggcatctggcccattttgatcagcacaaagatattcattccgaccgcccacagcccgtatttcacaagggttacaagcgcaagcgcttcaaacagcggcgcgtttcttccgatgagaaatgccaaaagcacaaacaggaagaaaaacgtcgccgtcgggctgtcaggcacaaacaccagaaaacgcagcggcgtgtccgcaagctgcggcaaataccaataatagccgtataccgtaccgataaaattaactgcaagagcaagcagaagcatgccgcgccgccctaaaagataagaaatccacctcataccatcaactctcagtccttaaaagatatgtatcatacaaaaaaagctgacatctggtcagctcttttcataaaagtatatcctgctattgtctgcttcacaatacgttatttcgatgttgtttcagaaatgaacttcgccagctgatcaagctgtttgtcattccctttaaaaacaccggcaggcatctgcccttttcctttgacggcgatcttttttatttcttccgggctcagcccgttatctatcagagacggaccggcgcctccgccttgaagattatccccgtgacaggatatacagccttgttctttaaatactttataaccgtctgattctgtatcaatagcggcttcttttttaattttcccttgctcctccgccttcgcccagtcatgcgtcgcgactgactgccacgttaaaaagatcgtagcgcaaagcgccaaaagcatcatgccgaccgcaaccggacgcttccacggccttctttcagaaccccggtcgagaaacggagccaaaagcagcgacccgaaagcaagccccggtattatcatcgcgccgattacggtgtagctccctgcggcatattcatattttaaaagctggtataaaaatagaaaataccaatccggcagcggaatataccccgtatccgtcgggtccgcaacccgttccaaaggcggctcgtgcacaatcgttaaaacgagaaatccgacgaggaaaacggctccgaccatccattctttcagcaggaagttcggccaaaacgcctccgtctttcccggatactctgaatagtctttcggtatattcggttttttttcagccggtatccttgaatctcctacaaacttcattcctttcccccgatgcatgtcatcccctcccttttatatcagatctgtattaaagcggtcctgaaattccctgcttgcggatcatgacaaagtgggcgcccatgagcgcaaacaaagcggcagggagaaaaaacacgtgaatcgcaaagaatctcgtcagtgtttgggccccgacaatatcgtggtggccggcaagaagggttttcacctgcgctccgatcaatggcgtcgcttccgcaatctgaaggcctacctttgtcgcaaacagcgccttcatatcccacggaagcaggtaccctgtaaaaccgagaccgagcatcacaaagaagattagaacaccgacgatccagttcaattcccgaggctttttataggctccctgaaagaaaacccgcagtgtatgtaaaaacatcattacgataactaaacttgcgccccaatgatgcattcctcttacaatctgtccgaaagcgacttcattctgcaaataatacacagattcccacgcgtttttaatatccggcacataatacatggttaagaacatcccggacagcacttggataacggttacaaaaaacgtcaatccgccgaaacaatagacaaaagctgagaaatggtgagctggattcacatgttccggcacttcatggtcagcgatatcccgccacatcggcgtaatatcgagacgttcatccacccagtcatatattttgttcagcatgtcacccttcccccctaggctttgcttttccaagatacaaaaagccgtcctttactttatgctcataacggtcaagaggcgcgagcggcggcgtgcccggaacgttcgtgccgtctttttcatacagcccgtaatggcagggacaaaagaatttgttcggatttttaggatcattgttccagtttacggtgcagcctaaatgtttgcagataggcgaaagcgctataatttcatccccatgcttgtagacccaggctgatctggattcttccgatttgtgccaggcgtcgacttgatgaattttaaagtcaaaacgcttcggctccttcgtcagctcatccacgctgacaacctgcaccattttttgatttcccgtcggttttaataccgggtccagcgcaaaacggaccataggcataagcgcactggcggccataaatccccccacgccggtgagcgcatagtttaaaaattgccttcttgatatatcttgttttccgcccatctcttccccccctaaagattgaccaaaaattaactaaaatagaaaataattctgagatttgacaccctcataatatatgaatctttcagcaaggtcaacagaggcaaaacggctgttttgcgggatgtgcggagtttttaagaattgttccacttctgtaacaaaacgttcaaaatttctccgcacttgtcatccgctatttttctctttaaagagtctttcatatgttcaaacggaacggcaggtatgcagatgacatcagagcctatttcagagtccttccatttttcgtctgccgtcagaaacaaggcgtgccggaaattgatcatcacctcttctttgagtttttgaagcagggcgatctgtaattgatctatatcaacatatgtataagaggggaataaatatacccgtcccttcaattggcgctcaagctcttcagaaagcaattgggtgctttccccctgctcaacggcttcttttaagcctcctgaagatgatatggaaattaacggaatgatagcggtatcaatgtaatctacagattgtaaatagacctcggcatcagcggccctccatctcatgtctggttcctcctctttacgcaacaagccttgcatattctgcaaggctgtcatttatgtgagctgattcaactggcgggaaagcttttcaaatgtttctttgtcgtggcggtccagcgcctcgtcgatatctctaagcagcttttcccgctggaaagtggaaatggcgtgttctaatattttttcagccatcccctgatcctgtttattttcaaacaggtctttcggcagatgcggatttgattcaagaacagcagcatattcaggcgagctgtaagccgaacggaaattcagctggataaataaatcctgctgtttattcagccggatgtcgtgaaaagatttttccgcgtccgtggtcatgacattttctttgtaaaacctaaacggcacctcatcaacgcaatgagtagacatgatgatgcctctcgggcaaaattcggcttgttctacaaaatggactttttccattaatgtatcatgactcattaaataatttaaaatccagacgcactcccggcgtttaagctgataatgatttaaaaaccaacggataaaatcctttttttcattgacagaaacaggggtctgcatgtaattccctcctctatcgatcgtataatctgacatcacttatacattcagcaagcatggtccaaaatcctgcttatctcaaaaattcatcctctatccgtaagattgtttcttcaagctcttcgtttgttccatccattgaaagcacttgttttaaaagcggcagcgcttctttctgaaggccttcttccaataagaagtgagcgtattcatacaagaagtcccgatcctcctgataatggagatacgcagcttcgaagctttttttcgcttccgcatactgctcgagacccgtataggcacttgccaaataccaattgtatttcggatcttcctctccgtaaccgcggacttcctgaatcagatcaataatctcttcaaagctttcttctttatgatagacggctaaaagcgtatggagcgcttccacataacccggatcgagcgccagcgcttcctgaagaagctttttgccttcgtcttcgttcccgagctttaacgccattttccccgcatagagaaaaagctctttattgtattcatcgtaagtaataccttctttagcggtttttaatgcatcctcatacatgccttctgcttcgaagctttttgcaagcggcatataaagcgatgaataagaaggatcaagcccttttaaatcagacagctgcttgatggcggttttgagcattcccgcctgataggctgtgaacccgtatccgaaaatcgtattcggttctgtatgttctgcagccgctttttcataccatgaaagcgcttcttcaaattcccccgccgcgctcaatgactcagccagcctctgatgaacatttacgccgccgatttcgttccgctcttttgccgtctcttcgtaatacggaacggctttcgcgtatgctccctgtgtgaagtataattcccccagagcgaaatcaataacaggctcatcttttaacatcgctttcgcctgtaacagcttttgctcacttacttcgaataagccctgcatctgatacagatcagccattaaaagaaggctttccgcgtaagacgggtcttccggagaaatcgtctccagcacctcgagagctttttcttcttcatcaatatctattaacaattcggcgtaaaaattcgtcagctcagactcctcaggataaaggtcatgcagatcactgatcagcgttaacgctttttctgcgtttccccattcatagtagagctgggctgcaatggctttgtcttcgtcatgaagctgtgtttcagcttttgaaagcgctttgagtcccttttcggtttcacctgcttcaactaattttatggcttcttgaatcaatgtattcaaatcagaccggtcctttcttttcctatacctcatcaaccaatgaaaagggtttttattcgggttattcttatcataattcagacaggagctgcccgcaaataagatgcttcacccggcattatagtttatcaaaaaattgttaagaggaaaacgacaaaaaaggggacggcatctttatacgcaaacagcgcgattgattccggctgtttctgtaacgaaaacgcatccccccttccttttcgtttaagacaagctatgtcaaagcccaagactttatgacacatgaagaaaaacccgaagaatcatcttcaggcttttttggataattgatctaaatgctcaaaaaatgtcggatatgaaacgcggatcgcatctgtatcatggatctcaatcggctcttccgtcagacatgaagcgataccgagcatcatgccgatgcggtggtcgccgtggcttgatacacccgcgccgccagcaagcgtttttttgccgtgtattttcatgccgtcttcagtcgcttcaatgtctgcgccgattttccggagctctgatacgacggtatcgatccgattcgtttccttcactttcagctctgccgcgtctttaatgacagttgtgccttcagcctgcgtggccaaaagagcgataatcggaatctcgtcaattaaacggggaatgatttctccgccgatttctgccgctttcaaagctgaagtttcgataaccagatcaccgtaaggctccgcgctgtccgcttttgacagaatcacttcaagtgaagcccccatttgctttaagacatcaataattcccgtgcgtgtcgggttcaggccgacatttttcagcacaatccggcttccgggaacgacagcgcctgccgcaaggaaaaaggccgctgaagaaatatcgccgggcacgaaaatatcagctgcccgaagcttctgaccgcccgttacagaagcgctcgtctctgtttccgcaagctcagcgccaaaagcattcagcatccgttctgtatggtctcttgatttatggggctctgtcactgtcgtcgttccttctgcctgcaatccggcaagcagcacggcagatttgatctgcgcgcttgcgacgggggaaacgtaatcaatgccttttaattgtccgcctcttacggataatggcgtaaattctccgtccgctcttccgtcaatcacggctcccatctgttttaaaggctccgttaccctcttcatcgggcgctttgcaatactttcgtcgcccgctaccgtactgtgaaatgggcgtccggctaaaatgcctagcatcaggcggatggtcgtgccggaatttccgacatcaagaaggctgtcaggctcacaaagtgcgtcaatgccgttcccgtgtatcgttacatcacttccgttctgttcaatggagacacccatttttctgaagcaggcaatggtgctcaggcaatcggctccgggcaaaaagttttttaccgtagtggttccttctgcaagcgctccgaacataacagaacggtgggagatggatttatctcccggaatatgaatttcaccgtttaaagacgtcactttttctcttttcaatgttctccacctcagtcagcgtaaaatgtttcatatttggcgcgggattgaatgcaggtttccgcccgcttgcggtcatcatcagtctggaaactgattctcagaattccgttaatatcttctcttgtttcgataatgcggatgttggtgatactgattttttcatcagccaaaatcgccgtaatttccgaaatgacccccggatgatcgggaacatcgacataaaggtcataaaaggacgggatcgcccctttttgacggagcggcaggccgtcgcgataatccttcgcttttttaaagtaaccgaacaggttgtccgcatcttcattttctacataagattcaatcgtgtcaatctcccgtttccattctttgaagcggtcaagcagtttatctttgttatgaaggagtatgtccctccacatcgccggactgcttgaggctatccttgtgatgtcccgaaaaccgccggctgcaaaacgctgcaaaaacggataatcttcttcagattggtgagcctgatgtacgaggcttgcggcaacgatatgagggaaatggctgatgacgctcgttacgccgtcatgctcctcgggagtcatctccacaaagtgggcgtttgccgctttcagaagttccttcaaatgcgatactgactctttagaagttgattttcccggtgttaaaatgtaaaacgcgttttcgaataaaaattctttcgcggcagcagccccggatttatgagaccccgccatcggatggccgccgacaaattgatagtgagccggtagcactttgtcagcatagctgacgactttctgctttgtgctccccacatctgtaatcaagagttcatgggtaatgcccgatgcggcaagcatatcaagcattttcagcgtttgcgcgacaggcgtggcgataatgacaactgacgcctgctgcgccccttccgtaaatgagccggcccgttcgtcaataatcccgagcttcagcgcggcagtaagctgttcttccgaaatatctacaccgataatccgtttatgcggatgctcttttttaatggccaatgcaatcgacccgccgatcagcccgattcccgcaagcaatattgtgtccttcatttcactcatttcctttttcatctagtttaatagagtaaagaggtgacgcttgatcacctcttataatatttcagctaaaattgtcagaatttcctcattctgctctttcgtaccaaccgtaatcctcagtgcagcaggaaatccgagcgcctgtcctgagcggacgatataccctttttccagcagggcttggaacagttcatccgcagggcggttaaattcaatgagcacaaagtttgtttgtgaaggataacaagttaaaccatgggtttcggcaaaatcataatactgcttaagacccgctgtattttttttgacacattccttaataaacgactggtcgtcaagcgcagccagtgccgaagcctggccgattctgctcgtattgaacggctctctcgccggttcaatctggcggatcagcgcttcattcgcaataccgtaaccgacgcgaagcgcggcaagtccgtatgctttagaaaatgtgcggaggatcatgatattcggatattgctttaaaagcggaatactttcagggtaatcttccgctgtgacatactcgtagtacgcttcatcaagtacaacgagaatatgctcgggaactctgtctaaaaaggcaattaactcttgttcagaagtatacgtccccgtcggattattcggattacatacccatatgactttcgtcttgctgtcaatggcttcaagcatccggtccaaatcatgagcgccgtcactgcggagcggcacctcgcgcacttcagcgccttcaatcaccgcattgtgtctgtattgcgggaaagtcggagcagcggtaatcgtgtttgcctgatcatttaataaagaacggcagataatctgcacaagctcatcagagccgtttccgaaaatgatcgaagattcactgacctgcagatgttcactgagccgcgttctcaaagcggcactgtaaccgtcgggatacagcgcaagctgctcaatctcctgatgcagcgcatctttagcggcctgtgaacagccgaacggattttcgttagatgcgagctttactactttctcaagcccgtactccattttcacttcttctattggtttgcccggctgatacggtttcagctgccgcagctgttctttaatctgcaaatccagtcacctcattttacactgtacagttgtccgaacgtctttgcgtattcctcaaattcaagaagcgcatcggctcttgtgccggaattcacaagctttgttttaagctcttcaacctttctgacaagcgcgcttccgacaacgacaccatctgatatttcattcatctcgtcaacctgtttgcggcttgaaatgccaaaaccgaccgcaaccggaaccgagctgaattctttcactttacggatgaaagagtatacagacggatcgaattcgctgcgtacgcccgtcactcctaaagaagatacacaatacacaaagccgccggcctgttcagtaattattttcaaacggttttcacttgtcggcgcgaccagcgagatataagcgatgttctcctttttgcatgtcttttgcaaaagggcgctttcctctaacggaagatccggtacaagcagaccgtctatgtcgttttcccgcagtaaagcgaaaaagcattctttttctaattgtaacacaggattataatacgtaaagaggataattggaatatgaacgccgttttttttcattttgccgccaagttcaatggcttttacgatattcattccgttttccagagcccgttttgaagcccgctgtatgacggggccatccgcgagcggatctgtgtaggggacgccgatttcaagagctgaagcgcctgcattctgcaaagattttgccagttcaacagaaatttcaggaagcggatcgcccgccgtaataaaagggataaataatttttcagagtcatgcagattaaacatgtgtcttcaccccgttttccaaaacattcatcagcgtatgaacatctttatctcctcttcccgacagactgacgagaatgattttgtctttatccatgtctttcgccatttcaaatgcttttgccaaggcgtgtgcagattcaatagccggaagaatgccttctgtttcagaaagcagacgcaacgcggcaatcgcttcttcgtctgtcacactttcatatgttacacggccgcttttatgcagataggcatgctcaggcccgatccccgggtaatcgaggcctgctgaaatggaatacggttcgataatctgtccgtatgcatcttgtattaaataggtcattgagccgtgaatcaccccgagcgtcccttttgctatcgtcgccgcatgcagaggcgtatcaattccttttccggccgcctcgacgccgatcagctcagtatcttcgtctaaaaaggcctgaaatatgcccatcgcattgcttccgccgccgacacatgcaacaaccttgtccgggagcgtcccttcgaccctgaggagctgttctttcgcttcctcgccgatgattttctgaaactcgcgcacaatgtacggatacgggtgcggacctacgacagaaccgatcaggtaaaaatggtcttcacaatgctgaacccaatatctgatcgcttcattcgtcgcatctttcagtgtgccgttgccgctagagaccggcacgacctccgcgccgagcagtttcattcggaatacgttcagcgactggcgcgcaacgtcctcttcacccataaaaaccgtacactcaaaaccgaattttgcggcggctgtcgcggctgcaacgccgtgctgccccgcaccggtttcggcgatgattttcgttttgcccatctttttggcaagcagaatctgtcctaacgcgttgttgattttatgagaaccggtatggtttaaatcttcccttttcaaatagattttcgccccgcccaaatcatccgacaccctgtctgcaaacgtcaatgcagtcggtcttccggagtaatcaaacaatagttttttatattctgcatgaaatacgggatcattctttaattctttgaaagccgtttcgatttcttcgagaggccgcatcaatgtttcagggacaaatttgcctccgaattcgccgtatcttccgatttcatttggatatggatacataatggttcatcctttcttctaaaagccggatcagtgtttgatccttttgtccgtttttttcaatcccgctggcaagatctataccgcacgggcccgacttgagtaaatcagtaatcgtttcaggattaacgccgcccgcgataaaacagcgcttgtttgcattttgagcccgcttccggtacaaggggacacgggtccatgaaaacgcgattcccgtgccgcctctcattcctttcactgaagaatcaatgacatagccgtcgacggcgggtgcaaattgatccatctgacggagcgtcccttccccgtgacggagcgctttccatatctccgagcgcacaagcggacggagacggagggcatcctcaggcgattcatcaccgtgcagctggatgacgtcaagggacaattcagaagcgatttgcgcaatgttttctatcgtttcatttacaaatactccgacatgtttcttatctgtccggatttcctgtttccatttccgtacttcatacggcgtgaccttccgtttgcttgcggcaaaaatgaatcccaaataatccgcttctgaggctgccgcaagctcataatcacgctttgagcagatgccgcagtactttatttcaggctttttcatgccctcactccccgaacagcccgcggatcgccttttgctgcgaatcctctctcattaaagattctccgatcaatacagcccgcgccccgtgcttattgacgaatttcaggtcagccaaagaaccgatgccgctttcgctgaccagcagacagccgtccggcacaagatccgccattttttccgtttgtgaaacagaagtacggaacgtttttaaatcccggttgtttatgccgagaatttccggctgaaacacctgtaaaatccgttcaaggacggtttcatcatggacttccacgagaacgtccatatccttctcacgggcctccagataaagctcatgaagctttgagggttccaacgcttccccgatcagcaaaatcgcatcggcgccgatccggtacgattcctccacctgcagggaatcaataataaaatcctttctcagcacgggaagagaaacggtttgtttcacatctgtcaaaaattgatttcttccctgaaaaaaacgggtatccgtcagaacagagatggcatccgctttggcagcttcataatccgccgcaatcttttcgggaacaaaatgctctttaatcagtcctttagacggcgaagctttttttacttcggcaatcagtccgataaaacggttcgggttcaggatcgcttctttaaaggatctccgttcaatttgacggttttccggcagcacgatggatttgatttcttcttttttctgctgaatgatttgatcaagcatatatttcttcctctttctgtttcagacgttcgagctgctttttggcatctccgttttgaatggtttctaaagctgtttttgttccttctcccagatcttttgcaagacctgccgtataaatggccgcgcccgcatttaaagcggtaatatgcagagcggatgacggggcttcatttgcaaaaatattctgaatgaggagcgcgctttcttccgctgaactcacctgaatatccttcagtgaaccttctgcaaaaccgaattgttcgggtgacacggaatattccagacgttccccgtttttcagctcaatgacatcggtcggtgctgtgatggacagttcatctaatccgtcacgcgccgatacaagcatgacgtgcctgacatcaaattgttccagtgcgcttgccatcaggcgcgctttttcagatgaatagacgccgatcacctgccgcttcgcctgcagcgggttgctgagcgggccgagcaggttaaatacggttcggaagccaagctcttttctcgcggcagcgacatgcttcattgacgaatgaaacagcggcgcaaacaaaaaccccatttgcttcgtttcaatgctgcgtttgacgctgtccggagtggcttgaatggaaacccccagtttctccagcacatccgcgctgccgcttttagacgaaacggaacgatttccgtgcttggcaactttagctccggcggcagaggctgtaattgccgctgccgttgatatgttaaacgtagaaatcccgtctccgcctgtcccgcacgtatcaacgacatcctcgaggccatctgcagcttgtgcacgcgcccgcatcactttcacaaatccggcaagctcctccgccgtttcaccccgatgggctaatattgataaaataccgccgatttcacactgcgacatatctccgttcatcatcatctccatcagcttttcggcttctccggttttcagcgtgcggccattaacgcacaattgcagaaatttgttcatcagtcttctcctccccgtcagaaaagatgtcttctgcaatttgaatcgtttttaaaagcgcccccgctttgctgcagctctcttcatattcagcttccgggacggaatcagcgactattcccgcccccgcctgaaccgacgccgtaccgtttttgacactcatggtccggatggtaatacacgaatcaatcgaaccgtcaaatccgatataagcgatacatccgccgtaggtctctcttgaagtcggttctaattcatttaaaagctgcatcgcgcggattttcggagcgcccgtgagtgttcctgccgggaatgccgacatcagcgcgtcaacgggatggacgccctgttttaaacggccggttacaacggagatgatgtgcatcacatgtgaaaaagaaacgacctttgtgaattcaggaacggttacggaaccatactccgcgactctgccgatgtcattgcgcgccagatcgacgagcatgtaatgttcagctttttctttttcgtcattcatcagctcttttttcaggcgttcgtcttctttttttccggcgccccttcttctcgttccggcaatcggatgaatttccagatgcctgtcatgcacacggatcagccgctctggcgaactgccgacaatgtctctgtccggcagtttgatatagtacatataaggtgaagggttgacgatgcgaagcaccctgtacagctcaaatgaatttctggataccggaatatcaaacttttgcgacagcaccccttgaaaaatgtctcccgcttttataaattctttcagtttattgacgccggccataaacccttctttcgtataattagatgtcacattggcaaagctcggcgtgtcaaacgttgcctttgaaaaaaacggctcttttatatccttcggttctgttaaaataccgataagctcccgaagttccgcacaattttctttaaaaacggcccgtttttcttcttccgtctcccggccgttaagcgttgcatattgaataaaatgcacttgtttcgtttcatggtcgtacgcaatgattttccggcagacaaacagcatgcatttttctagatctgtttctttcgcatgccttcgcacagaaggctcgatcagaggaatcatatcatagctcaggtagccgactgcccctcccgaaaatggaatatcaagctcgggcgttttaatgcggaagctttcattcatccagtcaagcaccgctcttaattctccggcttcaaacagcgtatgccctttcggatcagcagcagcgaatgtgttatgactctctttaatcgtgataaaaggatcgaggccgataaaagaatatcttgaccagcttgacgactcatccttgctttccagcagatacgtaatgtttctgtccagtttttcaaccatctgaatgggtgtgatcgtgtcgactgtaaaagtctctgcgattggaatggtgcggtgtgtcagactgtcctttaaaaataaagaaacatccgattgtaaattcatgattctcctccttgcggtaaggagaatgagatgaagagtgagaggagtgttgcgtataagaaataaacccaaaagaaaggcttcttttgggcagaataaaaacgtgtttatctcagctcagctaaactcattctctgctaccctattctaaactcaactgttcaatatcttgcttatcagctttatacacactcttgtgtatttctaagctttgtttatcgtattacatgtcagtattttttgtcaatgataaatccggtcttaacacaacggctttttctagataaacatgtttgatttcatcctgaggcgtatccgtctgaaccgtcatcaggacgcggacacactttttcagagcgccggcgacatccatttcctgcatgcacgtcaccgggacgtactgccatccggaaaggctgcggaccgcttttgccggaaatacggaatggatatcaggcgtggcggataacaggatctgcacaacgtcttccggtttgcatccattttgttcaatgattttttcaagcagctgctgtgttttttctaaaatttcttgttcggtgtcttgctccaccgttgttgctccgcgaatgccgcgtatcatcatgctgtttcctccattcgccatttgttcagcaagttttcaagctcatcttttgaaagcatacagtcctgtgcttcgcctaattccttcaatacgatgaactgagtcatgcctccgcgcgtttttttatcattcatcattctggcggagagaaccggcgtttcaatatcctgtctgatgcttcccgggtagccgagtcctctcagccattgcgtgagttcttttctgttcatcttgcatcccgcaacctgttcacttacgtaaagagcaaactgcatgccgagggcgactgcatctccatgtgtaatccggccgtagccgtattccgcctcaacggcgtggccgagcgtatggccgaaattcaggaaagctcttatcccctcttccttttcgtcctcacgcacgacggccgattttattgaaattcctttataaatcatttcattcagctcagcgcttgtcagtccgtgtaacgtatcaaacgtgagcagcttttctaaaaaagcgtgatctgcaataaacgcatgtttgatcacttcagccatgcccgatctcagctcttgttccggcagggttttcagaagctctgtatcataaatcaccgcttttggctgataaaacgcgccgattaagttctttccgagtttgtgattgacagccaccttgccgccgaccgcgctgtcatgggccagcagcgtcgtcggcatttggatgaaatcaattccgcgcataaaagtcgctgcgcaaaagccggccaaatcacccgtcacgccgcctccgaacgcgatcatacatgaggaacggtccatatggaaagcgatcgcttccgtttgaatccgttcatactcttccaatgacttcgcttcttctccgcttggaacgatcacttttttcacgtcccatgtttcgtttaaaagcgtgaacatttcatcaccgtaaagccggtcgacttcagcgtcgataacgagcagaatttttgtcagcggcctgttcagcgaagccaaaagtgcagcggcctgtttcctaatgccttcaccgatatacacgggatatgcggaggaagctgtccgaacctcaagctccttcatcagaattccctcgataattttctcatattttctacattttctttaatgcggtcgatctggtcgaggccgaattgttctacgacggcatttgcgatttcccaggccactgctgcttctgccactacgcttgctgcaggaacggcgcagctgtctgaacgttcaatactcgctgaaaacggttctttcgtttcaatgtcgacgcttttaagcggcttgtataaagtcgggatcggcttcataacaccgcgtacgacgatcggcattcctgtcgtcataccgccttctaatcctccgagcctgtttgtcgcgcgtgtatagcctttctcttcatcccacacgatttcatcatggacatcactgccgtttttgccggccgcttcaaaaccgatgccaaactctacgcctttaaacgcgttaatcgacagaacggcagcggcgagcttgctgtcaagtttacggtcataatggacatagcttccgacaccgacgggcatgccttcgacaatcacttcaacgattccgccgattgagtcgccgtttgccttcgcttcatcaatggctgccatcatttgacggcctgcttcttcgtcgtagcatctgaccggtgattcctcagttacccgcttgagatcttcaatagatgtgtaatcggttttctcggcttttaccccgccgatttgcagaacatgtccggcgactttaatgccgagctccgctaaaatctttttagcgacggctccggcagccacgcgaaccgttgtctcacgcgcggaagatcgttctaacacatttctcatatcgcggtgattatacttaatggccccgtttaaatctgcgtgcccaggtctcggtcttgaaatctggcgtttcatttcactttcttcttcttctgtaatcggtgctgcgcccatgatttttgtccagtgggtccagtctttattttccacaacgagcgcgatgggtgaaccgagtgtccgtgcatgccgcacgccgctcgtgatctttgccctgtccgtttcaatctgcatgcggcgtccgcggccgtgccctttttgacgtctggcaagctcaaaattaatgtcttcctcagttatataaagccccgctggcacaccttctataatcgtcgtcagctgcggaccgtgtgattctccggctgttaagtatctcatttctttcttctcccttcatcgcattaacgcttttaagtaaaactataacacaagttttcataaaatgtcttctatcttttttgataaaaaaatgtatcggtgctttcaaggccgaatttttccgggctgaaaatctgttctgtgcttccgacaaacagaattccgttctttttcaggctgcccgccattttcacatacagctcttctttcgctttttcagtaaaataaataaaaacgttgcggcagacgatcaggtcaaaatcctgttcatagctgtcagcaagcaggttgtgccgcttaaagcggatgtttttctgtatctcttgctttacttgatagctgttgtcgtcctgcttggtgaaaaagcggctttttacggaagccggcacctcttgcagcgagcgctcctgatagatgccccgcttggctttgctgagcgccttttcatcaatatctgtcgccaatatatcaaatccggccagtcccgcctgctggttgagaatcatcgccaaggtatagggttcttcccccgttgaacaggccgcgctccatatttttaacggtttgttatggtttaataacggaagaatggaagtttcaagaacttcccaccgtttataatttcggtaaaattcagaaacattgatcgtcattctgtccaatgtttcatttaataatagcttgtctttttccaaagcggccgcaaattcctgaaaatccctgaatccctttttttcataaagggacgtcagccgccttttcatctgtgcttctttgtataaagataaatcaacgccggttatttttttccacttcgtgataaaaatttcgtaaggctccattgcttctctcccaatctcgctgtcttttgtcctagtatagcctgttttctttctaaattgtacgatttcaataaaaaaatcagcccgcaggctgatttgtgagaaatgaaaagacaggacagcaaggcctctgtctttcttaaacgatgtaaaccctttcataatacgagaaaaagaaaggctgacggcttagtacacccagtcggccattaatttttgatacggtacaagctcttcctgtttaaagaaaatctgaatttcccgctcagcgctttctaaggagtctgaaccgtgaatgatatttttgccgacaaacatgccgtaatcaccgcgaatcgtgcccggcagtgcgtctttcgggtttgtttttccgatcagctgtcttgtgatctctactacattttccccttcccataccattgcaaatacgggtcctgatgtaatgaattccacaagctcgccgaaaaacggtttccctttatgttcagcataatggttttcagccatctgttctgaaacttgcattagcttggctcctgccaattgtaagcccttacgttcaaatcttgataaaatctctccgatcagctggcgctgtacgccgtccggttttaccatgataaaagttttttccataagattctccaccccatcattatgtataggctttcaagttgcacaccgaaatcgtaacatctttctgacaattaatcaatccagggcggagaatgttcacatcttgttcgtaaaagggggttaaaatttccgtttgccgatatatttggcgattgcggccaatgatgagcgcgcccggcctctcggcagtgtattcagcttttcaaacgctttttttaagtacctgtcactgactgccattgatttttcaatcgcgtctgtgcgttttatattttcaataatgggggcaagctgctcctgtgttgtttcactgttaattaatttcagctgatttctcaattcaggctgatgcagcgcgtacaaaacgggcagagtgacatttccttgcagcagatctcctccgaccggttttcccagttcctcttcggtggaagtgaaatcaagaatgtcatcaataatttgataggacatgcctacataatagccgaaccaatataatgctttatgaatcttctcatcagctcccgaagcgatggcgccgagctggcagctgacggcgatgagaagagccgttttccgtttgatgcggcgcaaataggttctgaggttctgttccatattgtatttatctctgatctgttcaatttctccgaggcaaacttctacgatggttttggacaggatccggtgggctttcggctcatcgagtctcgtcatcatctcaagcgagcccgcaagcatataatcaccggtatacatggcaatgcggttgtcccatttggctttaatggtcggctttcctctccgcagctcggcgtcatcgatgacgtcgtcatgcacgagggacgccatatgaatcatttccagcgtcaccgctacatattttattttattaatgtcatagtcaccgaacatgccggaaagcaatacgaaaacaggacggatgcgcttgcctcccgcctgaagcagatggagccccgcttcgctcagcaagggatagtcagaccgcaccgtctgctcaagctccctttcgatcacatcaatatcgtcatttaaaaaagaataggccattttaaatttcatatcattcacccaaacatctgtatattcatcatttccaaccgatatgcgtagcggccactccgccggtaaacgaatggtatttgacattcgtcaggcccgcttcttcaaacagacgcgcaagctctttcataccgggaaattctcttgctgattcttgcagccaggaatattctttatagctttttgcaaacatttttccgaagaaaggcatgatgtatttaaaatagaggaaatatgcctgtctgaaaccgaacatttccggctgggatgtttctaggcatacgacctgcccgcccggtttgacgacccgccgcatttctttcagcacggtcaggtagtcgggaacgttccgcagtccgaagccgatggtgacaaaatcaaaagaattatcatcgaaaggaagttccatcgcattcccgtgcaaaagctcaatttggctgtaaccgccctcttttacttttttctcgccgatgctcagcatatttttgctgaaatccagtcctttgatttcgccgcttttacctgccgcttctgcgagggcaatcgtccagtcagccgttccgcagcagacatcaagcgcttttgcgccttctttcacattcatgatctgcatcgttttgtcgcgccattttttatgttgctgaaaactgataacagagttcatttggtcataatttttgtagattttttcaaacacgccgtgtacgcgctgttcttttgactcctgcatgttgattacccttcttccactttctgatgatatgttttgtcttggctgatcgcttgaagccggttcagcattagattttggattggtgaattgagcggcagcagcgtttcaatgctttgcttcgccttccggaagctttcttccagaatgtcagcctttgattttcctgactttacaatattgccgatgacatcgagaaatatagcattgccgttcatcagccgcttatatacaaaaaaatcactcgccagctctttccagcgcggaagattgaagtggtctgacactctgtgaaacagggccgcttccacaatcgccatgctttcaatcaattgattcaagtcattgacagaccgatcgtacagacggattttatgttcattgatttctttaattgccgtagcgagcgtccgaatcatatagatatccttcatttcagataaaagcgaatagtacagtccgctgaaatagtcgccggcaagcacggtgagctgccggtttttattttcgtctcgctttaacgctctggctgttgtcacttcatcgtgggtatcaagggcgctttggacaagcatcgcagttactatgtaattttctctgtcgttgttcttaatgtcagcctcttcaaacaaagcgtgaaaaagaagcagcttatcctcatcgattttcggcgcagaaatatgtttcgctaaataaggatgagacagcttttgttttaatttcgtatttaaattcgctaaagttccgtagatgtcttgcaaaaatatcacccttgtccccaaattcacatttattctaatatgtatgagatttattcgtcattattatacgcaggtatcattatagcataaaaaaaagaaattggctgtattctcccgccgtttgcgggcaatcagcaaaagcgggaaacagccggcttattttttttcgctgttcatttctccgtaagcggtctggatgagggcgttgcctctcactttgatggcggatgtatgctctgtaaactgagcgataatcacttcacccttgtccagtttttcggaatggtggaatttcgtatccgttcctctcgttaaaccgatgacgttcacaccgtcctcgaccgctttaatgacgacaaaatcacttgaatgctttgaattcatatctgcaccctctatcattattaatccgcacgtttaatatgttctaacacttcagaacgcgccgctgcgtcatctttaaaaatacctcttacagcggaagttactgtttttgcccccggctttctaacgcctctcatcgtcatgcacatatgctcagcttcgacgacaaccatgacgccgtggggatctaaggtttctacgatgctttctgcaatcgttgacgtaatgcgctcctgcagctgcgggcgttttgagacggcttctaccgcacgcgccagtttactcaggcccgtcactttaccgccgcgcggaatgtaggcaatatgcgcttttccgtaaaaaggaacaagatgatgttcacacatagaatgaaacgcgatatcttttacaagaacaagctcctcatgatcctcgccgaaaacggttttaaaatgctctttcgggtcttcgtttaatcccgagaatacttcagcgtacatttttgctacgcgtttcggcgtatctaaaagcccttcccggtccgggtcttctccaatcgcctctaaaatctggcgaactgcctgttcaatctgttctttattaacttctttcattgtctgtgtcctccaccattgaatacatttaatttcgattctagcacatttgccgcgccaaaagcaaaacgaaagtcctgcccggagaccgaggctgcttaaatatgaaaagcccctttatcaaggggcttttctgtgaagaaacaaagtgtatgtatcagatgcatacacgatctatattcacaattattttcctgcaacagcgtctttaagagctttacctggtttgaaagcaggtactttgcttgcagggatttcgatttcttcacctgtttgcgggttacgtcctttacgtgcagaacgctcgcgcacctcaaagttaccgaaaccgatcagttggattttatcaccatttttaagtgcatctaaaatcgtatcaaaaacagaatcaactgcttttgtagcgtcttttttagacaattcgcttgcttctgcaaccgcattgattagttctgtcttgttcatgcctttcacctcctcccaaaagggtatcaattcagcagtttattatcatttcttcacagttcagtctgattctaaacctgtctgataaaaaatcaatccagggaagaacagacaagtaaacggcttttcataagaaaacagacacttcgaggaatgtttgtccaacaaagtgaagattttctgtaagtagagtaacacatataaaaagccatatcaagcattttaaagccccaatcccttgctcgtcaaggttttcacgtgttttcccgaacaaatattcctttttttgcttttttcctcctaatccttgattgatttccagtatctaaatagacataaaaaaagaccccccgtatcaggaagaggtccttcagcttacaaaataattgcgatcaggccgcctgagccttcgtttataattctctccagcgtttctttcagtttatatctcgcattttcaggcatgagcgacagttttgccgagattccttctctcacaatcgagctcaatgatcttccgaaaatatcagagttccagatagaaagcggatcatcctcaaagtcctgcattaagtagcggacaagctcttcactttgtttttccgtcccgatgatcggagcgaattcactttccacatccactttgatcatgtgaatggacggggcgaccgctttcagccttaccccgaaccttgatccctgtctgatgatttccggttcatcaaggctcatatccgttaaggccggagcggcgatgccatagccggtctgtttcaccattttcagcgcgtctgatacctgatcatattcctttttcgcgtgggcgaagtcctgcattaattcaagcagatggtcttttccgcggatctcgacgccgaccacttcttttaaaatctggtcatataaatgatccggcgcgtataaatcaatttccgcgacaccctggccaagttcaattccggccaagcctgcgctttcaataaactcaaattcactgaagtggccgacaacccggtcgacgtcacgcaggcgtttgatatcttttacggtttctttcactgattcctggtaactctctctgagccagtgattttctttcagcaccatgacccagctcggaaggttgacattcacttccagcacagggaactcgtaaagcgcttctctgaggacgcttaacacatctgtttcccgcatgctttcaacactcatggcgaggacaggaatatcatatttcgcgcttaattcagccctgagcgcttctgtttccgggtgatacggcttcaccgagttgatgaccataataaacggtttgccgacttccttcagctcgtcaatgactctttcttccgcttctacgtaatcgccccgcgcaatatcgccgattgaaccgtctgtcgtaatgacgaccccgattgtggaatgttcctggatgacttttctcgtaccgatttccgctgcttcatgaaagggaatcggttcttcgtaccatggtgtattgatcattctcggaccgttttcatcttcatatcccttcgccccgggaacagtgtatcccacacaatccacaaggcggatattgacatcaagtccttccgccacatgtacggacatggcttgattcggcacaaattttggttctgtggtcataatcgtttttcctgctgcgctttgcggaagctcatcctgcgcccgcgctcggtcggcttcattgctgatattcgggagcaccacgagctccataaattttttaatgaatgtagatttccctgtacggacagcgccgacgactcctaagtatatatcgcctcctgttcgttcagcgatatccttgaaaatatcgaccttttccaagtgatcccctcccggacttcctatccttatcatttttcattcaccattcttcaatcaaatacaggacactatatgtgtatgacgttgtcccatttcaatatgacatctttagaaaattttcaggcaatcttttctatcggaatcaaaaaaacctttctccctatttgtatgcgcgggagaaaggttcattcctgtttcgttttactttctaaaaaaacgggttcctgtttttcatttacggtgtatttgactgaaaaggccgggacgaaaggagtctcttcccataaaatatcctgaatttccgcgcccggtttgattttctttttgttttctttcagacagcgggcgagatcgacgcgatagtcggcatagatttctccatcagctccgattaaaagcggcagagacgcgcctgaaaccggactttcgacagaaggagagtctttcatgccgagcttttttttatttaaagtgaacagcccttttgaaacggcgtcctcatagggtggatatgtatgcttttcctgatacattttgacacgcagctttatgtcgcggattgcctccgccatttggagatcgatcagcttcacagtcggcttattttccacatcgacaagcacgtattggtacattcctccgctttcaaaagcagaggacggcggctcctctatatatctgggcgcgagccgcttaaaatctatcggatatttttgatagatcggtgttttcatatcttttgtctgaatcggcagaagtccgccgttcgcctttttaaattcatccaccgccgcttgaacctgctgaagctgatgcttgtaagatactttattttcagttttttccgcttcaggatacagacagccggacagcagaagcaccgcaattgccgttatgacggccatttttaacttatgcattccgcgccccctttttttgctttattcattgacaggtccgctgaaaacgaccattaacacgatcaatcccgagatgaccatacaggcataagcgagtgaagaaactgctgcttttatcagcctgtttttaactttgtacctgctgacataaatagaggccaccgccacaaacattaatcccatagcaccaagcgcaaaccacattttcatcaatgccacactcacgtccgtgccccccgtccaatcattgtaagcgttatatttcattttaatatacaaatgttgaaaagatcaacaggttttccatctattgaaaaaaacaaaaaaactgaagcaaagagggggactttgcttcagtcaagttgactatattcacctatacgcctgagatacactctcttggacttcgatgctatagtatgcgtagatgcgtacgtctgcatcctcttctgcctaaatcagcaaatgttttgagcgatttcagccggagagttccgcgttttggactttcgtcacttcagaatatgctgacggcatgttattgtcactttacccggttttcgaatgtgttgaccaagtcttccatctcatgggttttcactctggccattaaggattctacggccgtttctaccttctgcccgttaaataacacttggtgaagcgcctctgtaatcggcattttcacttgatatttttgagacagctgatatgccgctttcgtcgtccgcacaccttcaacaaccattcccatctggtcaaggacttcttcaagcttatacccttttccaagcaggttgccggcgcgccagttccgtgaatgaacgcttgtacacgtcacaattaaatcgcctacgcctgtcaggccggaaaaagtaagaggatttccgcccatctttgttccgagtctggcgatttcagcaagaccgcgggtgattaaggccgcttttgcattatctccgtatcccaatccgtctgtaattcccgctgccagagcgatgatgttctttagcgctccccctatctcaacaccgatcatatccggattggtatacacgcggaaatgctggttcataaataaatcctgaaccgcttctgcagcctcgatattttttgaagatgatgtaacggtcgtcgggtgtcttaatccgacttcctcagcgtggctcggtcctgaaagcacgacgatgtcttttctgtactcctcaggcagctcctcctccattaattctgaaatgcggagaagcgaatccggctcaatccctttgctgacatgaacaaaaattgatttcttcgggatgtaaggcagagcctttttcagcacttcccgaatggcttttgtcggaaccgccacaatgatgaagtcagctccatttaaagcctcgcttacatcagctgttccgatgatagaacttgatagctccaccccgggcagataatctttgttttcatgcagttcgttgatttgatcgatcaattcggcacgatgtccccacatcatgacttgatgtccgttatcagccagcactaaagaaagtgcagtgccccagcttcccgctccaagcattgccacttttttcatctctgtatcacacctttttattttcttgctcttgcaaatattttaattggcgtaccttcaaatccgaaagcatcccggattcggttttctaaaaagcgttcataagaaaaatgcatcagttccggatcattgacaaaaacaacgaagctcggtggcttaacagcgacttgagtcgcataataaatcttcaggcgtgagccgttgtgcgtcggagtcggattcatggcgaccgcatccatgatgacgtcatttaagacatttgtctgtacgcggagagagtggttttcactcgctttaataatcgcaggcatgagtgtatgaatccgctttgtcgtcagtgccgacataaacagcaccggcgcataatcgagaaattggaaatgctcgcgtatattctgttcaaattctttcatcgtgctttcgtctttatcaacggcatcccatttgtttacgataatgacgacggcttttccggcttcatgggcgtatccggcgatccgcttgtcctgttcgaggatgccttcttctgcattcagcacaacgccgacgacgtctgagcggtcaatggcttttaacgcccgaagcacgctgtatttttctgttgtttcatatacttttcccttttttctcattcccgccgtgtcgacgatcacgaattcctgctggttataggtgaatgccgtatccacagcgtctcttgtcgtacccgccacgttgctcacgataacccgctcttctccgagcatcgcattgacaagggaggatttcccgacattcgggcggccgatcagacagaattgaacgacatcatcattatactttgtttccggaatgtttttaaaatgctcggcacatgcatcgagcaaatctcctaatcccaaaccgtgagtacccgaaatagggtacggctctccaaagccgagcgcataaaaatcatagatgttcgctctcatttcggtattatctaatttattaacggctaatacgaccggttttttcgtccggtacagtatttttgccacttcttcatccgcagacgtcacaccttcacggccgttcaccataaagatgatcacatcagcctcgtccatggcaatttcagcctgctggcggatctgtgtcagaaacggttcgtctccgatatcaattccgcccgtgtcaatcaggttaaaatcataattcagccattccgccgaactgtatatccggtcccgcgtcactccgggggtatcttctactattgaaattctttcacccgcaatccggttaaagattgtggattttcccacattcggtcttccgacaatggctacgacaggtttacccatagtacccttcctttcaatccagccgcttacattttcacaaaaattgttcaaccggttattaaaaatcatcttcgctatgaaaagaacccttcaaacagaagggcttaactcatttattatatcagttttcactgagatcacaatgtattcttcaaaatgtttcgcattcatgtaacagtctccgtccgttttcaagacatttttgtcgcccctttgccctgctttttgcttttttggctgatgcgtgcggcgagctgttcatatgtagtcagcccgacaagcaggatcactcccgccgagcagcctgaaagccattgatagccgccgacggctgccgcacccgcaattttgtgaatgaccgccgaatacaatagctctccttggcacatgccgagaacaaaaagacaaagcctttcaggaaatcgcccctcaacagagaccgtaatcacggtaagcagtatgaccgccgcccactcaggttttatgataaaccaaacagggtcatataatgcaaaaagaaaaataaagccgtacgctgccgaagccgtcagatgaatcacaatataacgaagccgtttatgcatgccgagactccccgcgtaaacaaatgccgcagcaaaaaacatgacatatgccgcgttcagcgtaaaataagccgtcatctgatgtatgcttgccatcatattagtcaaaataaagactgatacgtaaaaacggcttttcgttttggcaaaaataaaagtcgcaagtatccataaaaaccacatcgaccagtaataataaaacggttccataatcgctcctcctctgaccagtatggagcggtaacgtactttttaaaccaataaagctgaaaggagcagatgaagatgggtaaagacagacaggagaaaaaactgaaagcctcccgccgggtggaatcggatcgcgatgaatcgattcaccataaaggtgcgacaagcctcgagcaaaacggggaattccgaaaaagaaaatcgtaaacagaaaaaaaggcatgcgggtacgcatgccttttaacgtctgctgaaacgggatgtgtcaattccccgttcagaaagccagtgatgtgtgtcaccttttatgaccaaaggcgccttttgcaattgggcaaccgattgacagccgagaacggtcataatcattttcagctcttccaacagcgccgtcatctcgtcaaacagaccctcttctccttttgaggtgagagctttcaggaaaatgcccgccattcccgcagaagaagcgccgagggcaatcgttttagcgacatcaagcgcactttgcagccctccggatgcgataattgattgatcaacagaaagcgaatggatttccgctaagctggctgcagtggaaattccccacgtattaaaaaattgaagcgccttctctctgcgcatattttcaattttagaaaaatttgtcccgccgtacccgccggcatcaacagccgccgccccagcatcaaataactgccgtgccgattccctgctcatgccgaagccgacttctttaacgaaaacgggcactcccgcttcatctacaatctgctcaatacggcggagagcgcccgtaaaacttctgtcgccttcaggcatgacgatctcctgaatcacatttaaatgaatctgcagggcgtccgcctcaatcatatcaaccgcccttttcgcctgctcggcgtccgcctcgctccctaaattcgcaaatattaacccgttcggattctcttttctgacgatctcgtaagaataccgttcagagggatcttttaaggctgacatttgcgaaccgacagcaagcggcatgccggctttgcgcgcggctcttgccagtgacctgttaatttcgtatgtaagctgtccgccgccgcctgtcatcgcattgataaaaatcggcgaactgcttgtgagtccgccgatttccgttgagatatccactttttccaatgcaaggtctggcaggctgacatgaacaaacgtaatatcatcaagccccgtttcccggttttggccggtagacagcgcatgatttatatgttctctttttcgttctgctcgtgtcacgttttatcaccaatttattttaatttattgagcttgtccccgattaaatcgccaagctggaagccggtgctcggctcttctttcgcctggtattgacggaagtcctcctgatcggctttcggcgcttcctcaagctcacgcatgcttaaggagatgcgttcttcgctttcgttcacgtcaaggactttcactttaacagtctgtccttcttccagcacttcatgcggcgttccgatatgtttattggagatttgtgaaatgtgcacaagaccttccacgcccggaagaatttcaacgaaggcgccgaagcttacaaggcgctgcacttttccttcaagcacatctccctgctttaccttttcgccgatctggctccaaggtcccggcagcgtttctttaatagataaagaaatacgctcgttatcacggtctacggacaatactttcacttttacgtcctgaccttcttccaccacgtctgacggtttttcgacgtgtgaatgagacagctgcgaaatatgaacgagtccgtcaattccgccgatgtcgacaaatgcgccgaaatcagtcaggcgctgtacttttccttcaagaacgcttccaacctcaagcgtttggagaaaatcatgttttttggcagtctgttctttttccactacagcacggtgtgacagaatcacccggtttttatcacggtcaagttcaacgacgataagagagagggttttccctttatagtcagtgaaatcctcgacgaaatgagcttcgacaagtgatgcgggaatgaagccgcgaacgccgatatcaacgacgagaccgcctttcaccacatctttcacttcagcttcaaacacttcttttgtttcgaattttttttcaaggtcttcccaagcgcggtcagcatcaacggcacgtttagataaaatcaaagcatcgtcttccacttttgttactttcaggtcaagctcgtcgtcaacatttacgacatccgatgctttctctacatgaagacttgataattcactgattggaatgattccggactgtttgacattgataatttcgacatctacatgcttgtcctctacctttgtcacaatcccttttactacatctccaacctctggcacttgaacatcaatttgattcatttcctctgtcatttgaataacctccttggtccaaacctacacagcttaattaaaacggtttgaaagctgaacatgtgaatgtccgcttttcagccgaatatgtattaaagaatcatccaaaaatattttgaatgatcaataaaaagttttattagtattaacttctaataaaaggactggtttgtcaagcaataacatcttgttcttatgaaaaaaatttaaaatgcgctccggccaagttaacgtgatttctgttcaacgatctccagaatttttcctgcgacttcggcaatgctgagtgacgtcgtatcgatttcaatcgcgtcctccgctttgcgcagcggggaaaattccctttctgaatcgagtttgtcgcgtcttgcaatttcttcaatgagcgtttcgtaattcacgtcatagccttttttcttattctcctcaaaccggcgcttcgctctttcctctacggacgccagcaggaaaattttcacttccgcatcaggcagcacgtgagtaccaatatcacggccgtccatgacgacgccgcctttttctccgagctgctgctgtcttttcaccatttcttctctgacgcctttatgcttggcggcgatggatacttggttgctgacttcgtcttttctgatttcttctgtcacatcttctccgtttaccagaacgatttgtccttccggagcggatacaagctcaatcttcgtatgctttaacagctctgtgagcgcggcttcatccgttaattcggcattttgcctgagcgccgtatatgtaatggcacgatacatcgctcctgtatcaatgtacacatatgatttcttctcagctactattttagcaacggtgctttttccggcagccgccggaccgtcgatcgcaattgataatttcttgtccataatctctctccttgctctttactcctctatggattgtatcatgaactgcccgaaaaagggcgaaaaaaattgagctgacttaccgctttaccgtttcaatccattcttttttatccattttatcaactccctcatatttcacggctttcgaaatataaggttcaataggctgataatgaagcaaaaattgtaccgcgcccaaaatcacgagctgaatgcagaccaatttgaccagcagacgttcaaacgttttcatacacgcgcacctccattaggattagtatggaaaagtacgctgctgtttattccggctgactgtttcttctctgctgcagctgcgcgcgcatacagtattggagtaattgctgctgcgatccggcatcgatttctgtaaattcaagcgtcattttttgtttatccgccttttcatcataaaaaaaccgctgggtaaccgcttcagctgatatatcgtctgtattttccttacccggaagagagaatgagacatacagcttttcacccggttccacggaaatatgctcaggcatcacaactgcgattccgccggcgctgatattagaggaaaccgtttgaaaggcggtttttttcgcttttattttgacggatacattcaatacagcgtctgcacggacgtaccggcgtctttgaatccgcttcatttcctttttaggggggatatccaatccgatcatcgggataggatcttttttctttcctttgattatgcttttaaaatgatacggcacttggccattccccataaattccgctgttatttccagccctttgtgcaaaaagaccgtccgtcccgaatccagatcgacgggatatgagatatgcagttcgccgttttcaacgctgacagccttgctcctcgctttttttggctcattgttctctatgtattcaatccaaatataatctccgacagctatcatgggccttcactctttcattctttatgcttttattaaagcatgtaatgaaaaaaaggaaaagacttttagtcctttcctcctttatttttataggtctttatatataggttctgcactttttaatttttctattttttcctcttttccatcgtctgcatttatgaacatttgatacgtgtctttcccgatcgtcccgagtatttcgtagcaaagcacttcctgaccgagttcattcgtgatcagtgcctgccgcgtctcccgcacttcaacatttttattcagcttcgctttcgcttcatcagccgataaagccggagtcggaatcgttctcgtgtgatgcgcggccaggtaatcacgcgcggaaaaaccgacgacttcaccgtcatccagcgccactttcattcggatggcttccggatatatgcggacgtttttctcaacgggaataaaagagaagacgccgatgttattgtattgcgcgctttcatcaatttcgaggccttttgtttcataaccgtttttctttaaaaacgcgacggcccggttagatgcttcattaaggctgatcttttgtttcttcacggcccgcttttgaattaaatataccggatgtccgcctttttgggtaatatccatatagatcaacgatttgtgatcggcatcattcatgcggatgctgtatacgtcccgattcgtcttccggccgctcttgaccactttaatggaataattatgatcaggcgcaaaccgttccgcgatttttaccgcttctttttctgtaatttgtttgcctttcaaatgcgtaaaaccttttcgttctgtatttgttgccgtaaacgtggggctggtgttgtcttcagaaaaagcgcctacgtttttttcgactgttttaaagctgttgacgatcgtgttatcgctttgttttttgtcagaagcgagcgccatttcaacatccatccaccgtaaatttttgctcatgacgagatgctgaacgctgcggagctggttttgaatgttctccgcctgtttatacaggctgttcaatgtcgtatattcttttttatcaagcggtttttgatctaaatcccggacggatgttttatagctgaaatctcctatattggataaaaactcctccgtcttattaaaaggcataagtgtcagcggcagctggctcacattgttatgagcttcagatgttattctccatacatcaatgagcgccggtgacagagattttttactgttcatggcaagcgtcgtcccgattttgtcgtgaagctgatcaacatggtaagtcagttcatgaaaagccctctgataattattttccgcgtgcagaaggaccgcatccttttcctgatgctctttataaccccagtatccggttgcgacgatcacgacaccgagaacagcgataataattcctctaatcatgttaacacctcatttttcgtacttttactcacagaaaatgtgttttccgattcttttaatctgcggccgtccccaaatccatttgcttgtcgccgtatcagggttaaaataataaagcgcgttttcagaagggtcccagccgttaatcgcatcaagaaccgcttcttttgctctttcattcggctgcatatatatttgcccgtcggcaacggcggtaaaagcgagcggttcgaaaatgacgccggccaccgtattcggaaataacgggcttttaatacggtttaaaataaccgcggcgatggcaacctgtccttcaaacggctcaccgcgggcttccccgtacacagcctgcgccagaagattgatatcgttgtttgagaaaccgcccggcatattggccgctgtcgtgttttgcttttgttctgactgaccgcctgtattgttttgcggtttttgagcaggcttattcgttcccgccgccggcttctgtgcgcctgctgacggtttcgtttgattttttaaagggacgttgccgtaatgggtgaacgtattccctttttgaatctgctccattacatattcgcggtaatattttgattttgaaatcagcacctgtttggttttcgcaccgacgagaccgtcaaccgccttcatgccgaatttctcctgaaaatttcgtacggcccagtatgtggtccacccgtaaacaccgtcgattttcccgttataaaatccgttatattgaagacgtgcctgcaattctataacatcatcaccagtcgcgcctctttgaatcacttgatttgaaaacgcatgggccgtttcatgttcgaaaaaagcggcagcgaaagaaaatagaatgagacatgccataaacgctcctttgcacttcatcttttcaagcctcctcagcaaaatttaaactgtacccgtattgtctgtcacgcggttatttttatacaccgtttcctcttatcccccctaaggcataaaaaaagaaactgcacgcgatgcgcagtttcttcacacttgaatcatattgacggaacgtgctttttttgccttccgcagcccgaaccaccataaaaacagcataaacggcagcatataatatacccaatgattgagggcggtcagaataaaatcgtaagaaccgtgcagacatgaaggcacgatcagcgaaatcacaagccacttaacgcgggcttttttctgtgaaaagcgggcttttccgagataaaagcccataatcaccccgatcagcgcgtggcaggagaccggcagaagagccctgatgaaagcatgctcaacaccgtggccgaataaatagagaatattttcaagcgtggcaaagcctaacgacacactggccccgtaaacgattccgtcataatgctcatcaaaatgagcatgcgggtacacactgatcatcagaacaaaccatttcaccgattcttccaaaaaacctgaagacaaaaaagaaacgaaaaagcttcctccccctacatgctctttttcaagaacatattggataaacatggtcggaaacacgagtacaactccgagaaaaaaagacctcagcaccatatgtacgggttcattgtcatactgatcttttaaataaaaatagcttaacagcgcaatgccgggagcgattcctgcagagatgattgcaaacatcaggcaacctctttcctttatattcctatatctatcgtaccatgttgttcatatttttacatctttcaatttctaaaaaaagagcatatgaatgatcatatgctctctgcacccagccgttttgaaatttcttttgcgatcaagccgccgtgaaaacggccgttttcgataaaaatttcattggcgttatttcctgccgcaatgactccggcaataaaaacaccgtcaacatttgtttccatcgtttcttcccggaaaaacggtctgcctgattctgcatcaatctggacaccgattttttcgagaaaaccgtgatccggatgatatcccgtcatggcaaatacaaaatcgtttttcagcctgaccgtctcattccggcctgagcggaaaatgatctcatcttccgtcacttcttcaagacaagcgccgaattccatccggatcgtgccgtttctgacgagggcctcaaactcgggcagaatccacggcttgatgctcggggagtattcattccctctgtaaagcaccgtgacgcgcgcgccggacttcaccagttccaaagccgcgtccacgcttgaatttttcccgccgattacggcaacatctttatcaaaataaggatggccttctttaaagtaatgaaataccttaggaagctcttcacccggtatgttcatataattcggatgatcataatatcctgtcgcaataatacaaaacggagtgagatagcggtcttttgacgtttctacaagaaaacggccgtcttcctgttttgtcacgcgctccaccgtttcaaaggcgtttacgcgcagctcttttcttctgacaacctctctgtagtacgagagagcctgaattctgaccggttttctgttttccgtaataaaggcgacatcgccgatttctaatttttcacttgaactgaaaaacgtttggtgtgtcggatagttataaatgctgtttacgacatttcctttttcgatcacaagggcgttcacgccgatttgcttcagatgtatagccgccgataatccgcaaggacctccgcctattataattgctttttcttctgtcatgtccttcaactcctgcgattggcatttccatcataagtttccactcatataaaaaatctcctatatcatcataggagattttttttgtttatgcaaacgattggtttatatccagcctctgaagcgcgaagcctccgccattttccgcacgccgaccatgtaagccgcaagcctcatgtcaatccggcggttttgggacatttcataaatattattaaacgattttaccatcatattttccagtttttcttcgacttcttcttcactccagtagaagccctggttattttgaacccattcgaaataagaaaccgttacaccgccggcgctcgccaaaacatcgggaacaagcagcgttcctttatctgtcaggattttcgttccttccagtgtcgtcggtccgtttgccgcctctaccacgattttcgctttaatgcggtcagcgttttcatctgtaatttggttttctatcgctgccgggacaagtatatcacagtcaagctcaagcagctcctgattcgtaatggtgtcattgaaaagcttcgtcactgttccgaagctgtctctgcggtcaagcagataatcaatatcaagaccgtccggatcgtaaagacctccgtacgcgtcagaaattccgacaactttcgcgccggcgtcatgcataaacttagccagatagctgcccgcgtttccgaaaccttgtacgacgacgcgcgcgttctgaatatcaagaccttttttcttggccgcttcttttatgcagatggtgacgccttttgctgtagctgattccctgccgtgggatccgcccagtacaagcggttttcccgtaataaagccaggtgagttaaattcatcaattcttgaatattcatccatcatccaagccataatctgcgagtttgtaaatacgtctggtgccgggacatctttagtcggtccgacaatctgactgattgctctgacgtatcctctgctcagtctttcaagctctctgaatgacatatttctcggatcacaaacaattccgcctttaccaccgccataaggaagatcaataattccgcattttaaactcatccagatagaaagtgctttcacctctttttcagttacattcgggtgaaaacgaataccgccttttgtcggacctacggaatcattgtgctgtgcacgatagcctgtaaatattttcacagacccgtcatccatccgaaccggaattttaaccgttaataatctgagcggctctttcagcagttcatacacttcttctggataccccaatttttccagagctttatgtattacggtttgggttgattttaatacatcatgtttgtcttcttcattatgaccggtgaatcgatcggcttccatttgagttaacctcctaaaatcttctgtttctctcatgctccctttcagtgactagtatacaccttcaatatctccgtgcatagaagaaagacaatgatttttccattatttcgcttaaaaaaagacggccgctgaaaacagctgccgtttcgtctctttttttatgaaaaatgtctctcgatggtctccacagcattgccgtccatgatgagttttccgtactcatggagcctgtaaatcgtaatcgtcgcagggtgcccgtattcggccagcaccgcgacaacgccttctgcagaacgggagccgaggtcttcaagacttacatagtactggtcctcatagtggtagacggttccgccggtaatcccgatgcgatgaaggctcccggcaagctgaatgatatcttcaaacgaatggaactgataaataatatccgggctttcgtcaagtttgacctgcatctcgatataatcgtcgtcatattcgtcgtcttctgcgtccgcgtcatgatttttcgtgacaatcacaaccatgccttgtgcctgaagagaatatacttccaccgcgatcggaccattcgcttcaaagccgagctctgtatttgcttcattcatcatatctttaaataactggtggactttaaacgagtccttccagaggtcttcttttgtcagtccccgatcagtcagatcgtcgagggttaaaaagattttaatcttattatagttcagacgctcaagccgcataatgttccctcctgcctcttcttgcacacaaatcatataacacagtatatgaataaatgagtcataggttcttaatttgttatcagtttacaccgtgtacagcgggaagacaagcagaatgccgttttttatcgactcggccggatttgtttcaggaaaacggctcatccggtccgcacagggtgatgatatgcgtctcaggtttcgctccgagcctcagcggaacttttgtcgtcccgtagccgttgctgatcaggtaatgcgctttctttaccgttcccgtcccgcccaattcatacggaccgaaccggccgaaacggatttggccgccgtgcgtatggccgctgaacacagcgtcaattccgtcagactcattcatctgctcatggatgcccgggttatggcatagcagaaggtttactttgttttcgtccgtatgtctgattgcagattcgtaatcatccatcatcattctgatatcatccaccccgcagatcgtaaccgtttcccctttataagcaaactgaaccgattcatttctcagcgggatcactttatatgcctgaagaagagaaagcaatttttgctggctgacctcgtaatcattatttccccacacataaataacaggcgcaagagcagtcagacgtttgatgttttcctcgattctggcgtatggaactccgccctccgccaaatcaccgccgagcaaaacggcatccggcttataaactgatgcttcccggagaagcttttcatcaattaaacggcggtgcacgtcagatataaaaaagatggtgagcggcttcatccctttcattttatcaagcataaatgtatgtgttttcaggtggctgccgtttgccgttttgtacatgacagccgccataaccgcagccgctcccgccaatgagccaagaattcccgctgtaagcttcataaacgcactctccattctgtcattgtcttacattagacggacaaacaaaaaaagacgtttctatcctttccggaaaacgcctctttttatttgctttcaaaataaagattgatatcataccgatgtttcatcaggtgaaaaacagattctctcgccccccatttttccggctggggccataaatccgtgcttttttggataatttcacatctcagcttatgaaattcaccctcggctttttcttccttttttttaaaataataagaagtgcagtacgcaaaagcggaagccataatccagcacaaataaaccgtatggcctaatatttcctgcagaatcagctgcggagaagcttgaggggcattgaagcttttaaaaatcagcagtacgcacatcagggaaaagcaaacgagggacgcccactgccatcttcggcattgcttggcataattttcgtattttaatttccgtttaaccagcgcctgaagcatttgtttcgtcggtccgtcagcaaatcggtctaattgcttccataaagaatccattcgcttcacaccttgtccgttttcattggtacactatatgaaagccgcggtgaaaatatgtatttattcggaaagcgggatgttcagaacctggcctgtatacacatcgtttccgtttaacccattgtaactgcggattttttcttcgcctgcacggcttttataatatttcattgaaatgcggtaaagcgtttctttcggctggacagtatgctggacggtccgcactttttgctggacggtctccgcttgatcactgccggcagccggaactcgcttttcacggacagccggcggagactgctgttttgtctccgcgtattcggtttctgtcggctttacctgtttttctgaagctgtttccgtttttttcggtgttttttcactcggtttttctttcgttttttcagatggagccgcttctttcttttctttgtcctcagactttttttccggcttttttaaaagagcggtttcagatgtttctttctgcacgtccgctttcggaatcacggcaggcgcgctttcactgtggtctataaagacatcttcataatccttcgggtcaaatctgctgctgtttgtcatatacagaagaccgaaaaagacaccgattgtcacaacaataaacaggacggtcagaaaagtgaacagcggcgtttttgttttggttttttccttcacctgttcttccttttttttacgctcctcttttacagattgtcttgtcgggaggctgtcttcaagatattcaatttgttcatccgcggccgcggcaatctgctgctcggcacgcagctgctgagctttttttctttcaactcttgacatttccgtcatgcaaacccctcctaacatattgaaaacggacctgacaggcaaataccgcatcaataataaaatgtgctgtaaccggaacgaataaattaccggtccattcatagataagccccagcaaaagactgatgcccgcaaccataataaacagaagccatttcgccaagtatctgaaatgaagcacggtaaaaataaagctggccgcccataagccgatatgtgtctgcagaacgcctctgaataaaatctcttcgctgaacgcaatgagaagcgtcaaaaacaaaatgtgcaataccggccttttcttaaaaagcaatacattaataccgccgtcatcatataaatgcgaaggacaccatttcatcaccgccagatcggcaaaaatgacaaggacagcaagagttacaccgtaccatatgatattatcgtcacgtatatgccacagctttaaaaaatcgtgaacatcggtaaaacagaaaaagccgatgacagcagaagccgccaatatgagcaattgggtggcataaagctgtataacaatctccctgtctgagagctgatggatcaattcgctttgccgtttcagctgaactcacccgcagactctaaaccgaaaatccggtctaattccagcttccaatcttcaaaccgctccatgtttttccgttctcctttttgctcgtatggggtcagatccattccgcagctgctgcagcattgcccggttggaccttcaggctcatacgattcatcaaagtaagctaatagcgcttctcttatacattctttccgctccaataacgccgaaaagcggttcattttatgcagcttcttttccacgcggcatgtcagttcttcttgcagctgctctttattggtttttccttgcaggtacaggtggatggccgttcgcgcctgtgtttcctgaacgcccttgcttatcagaacatcccgaagctttcgctcatcgcttgtaccggcgtcccgtatgacggccagaatgccttccaggtcgtaatcggacaaactttctgtctgaataatctgctgctgaagctcggtatcgcccggcgctctcagcaaaatactgacacttgggctgccgtcgcggcccgctcttccgatttcctgcataaaggcctcggccgtttggggaggataaaaatgaataacaaagcggatatcagacttatccacacccatgccgaacgcattggtgcagcaaatgcaatcaagctggttatggataaattgctgctgaattaatatcctgtcgcctgtatccattcccccgtgataataatccgtccgctttcccgttttttcgttcagctcggccgcaagctcttccgcccattttctggtcggacaatatacgatgcccgggccctcgagcttttcggcaagctctgtgaccctgctgattttttcggcattatcagccacatgttcaatcgccaagagaatattcggccggttgaccgaatatagatggcgcaccgcatgctcaagtccgagcacatccgtcacatccctgagcgtttctttcgtcgctgtcgcggtcagcgccaatacaggcggcttgccgagtgcttgcctgaaaggtccgagctttgaataatcaggcctgaaatcatgtccccactctgatatgcaatgagcctcatcaatgacaaataaactgaccgggacgtttttcaaacgattcagcacataaggtgacgagagggcttcaggagacatataaagaaatttgtaacggctgatgttgctgaggacaaaatgccgctcgtcagaattcagcctgctgtttaatgccgcaacccgcttttctcctttcgctttcagctgctgcacctgatcttccattaatgaaagaagaggtgaaataatcagtaccagcccgtccattatgtaacccggaagctgatagcataatgatttccccccgcctgtcggaagcatggcaatcgtatccttcttttgaagcacgctggtgatgatttcttcctgcccttttttaaacgaatgcaaaccaaaattccggtataaagctttgtgcagctcagtcatgctgtttcaccgtctttgccagcgccagcctgatctgaaaatagctgaagcgcatctgcattccttcgcgaatccgtttaattttattcgtttgatgctgttttgcaaatgccgttatcatacgctgttcctcttcagaaatgtactgttctataaaaaatgcaggctgatgcagcgatatttctacgatatgatcttcgattgtggcagtttttaaatttctgattgcggcgatccgttcaatcggaaaccctttttccaagagctcataggtttttctggcagactgcgtgagcgcgctttccgactgcaggtcggacaacagttcgcgcagagctggatgtgcacattgcggaagcgattgaataacataatgtaccgctccccaaaactgaacggacacataccattcatcttcgttcagctgaagagcgagctgcttattcgtgctgccgattctgtcgaatgaggttagagaatagacgaaaataagcgcctgccgttcacttacgccttgcagaagctgaaacagcgtgtcatgcatttggacggagagttctttgacatctctggttttccgcataaaccgtttgacccatctcagcgtctgtacatcgtttgtaaccgggatatattgactgcattgatgctctttgtttgacaggacttgaatgagcagggacagccgcttccagaggatgacagccggcgtttgataattcgcgccgtggcagtgcttcggccaaggccgctctgcaaacgcccgttcaagcgtttgaacgccgcgtgcagtcactttccacgttccctcttcttttccggctgtaatgtatgagtctccggtgagtttatgcatcgaagcagcaatatcgccgcgttcgcactgtgaagccatgccgaaatatttagcgatctgaaataagcccgcatcctgaatggtttgagacgacttttttccttttaataaatgaaacacggcactcggagtccgttcgccgtctattttgtccagacagtcgagaaccacggtatcaaagtagtttatcgccaatctcaacacacctacatttcttctctcaacaagtttcgtttttttgttctttttattttaacagattttcatataaatttgacgtttaaagtcatcttttagggggaactgctatagagaatcccttatgtgataagcattctcaatcatttttctgttgaaatttgacaccaacatcattacaataagtaagaggaataggtgttatatttaaaaatatataaggtaaaccatttgttccaacacgaacaatctgggaggtttttttcatggcaaagtacacaatcgtagataaagatacgtgtattgcatgcggcgcttgcggagctgcggcaccagacatttatgattatgatgatgaaggcattgcattcgttacgcttgacgaaaataaaggtgtcgtcgaagttccggaagtgctggaagaagatatgattgacgcatttgaaggatgccctactgattcaatcaaagttgcggatgaaccgtttgaaggcgacccgctgaaatacgaatagaaaagccctccccgtgagaggagctttatacgtgaataagactccggctgttatcggccggagtcttatttttttgccgatccaacaaacaaaaaaaagcgcccggcctgtgttttacgaggcggacgctttcagtcattattgtgtttgaacgctgcgtttttgctcaatccaaggtttaagcttcgtaaagatgaacgtaaatacgatggtgatgataatgcctttcacaatgttaaacggcagaattcccgcaacaaccgctgtttttaactggctgtttgacagtgccggtgaatgcaaaaaccaagtatacgcgggcaggatgagaatatagttcaaaatactcatcagaacagtcatcgccgcggttccggccagcaggctcaccgcaagcccttttgcagacttgagttttttaaacataaacgccgtcggcaggataaacagcgtccccgcgataaaattggccgcctgcccgacaggcacgccggccatgcttccttgaatgatatactgcagaatatttttaatcgcttcaaccgcaatccccgccgcaggcccgtaaaccaaaatggcgataattgcaggaacgtcactgaaatcaattttcaagtaatccggcagacccggaaacgggaaatttaacagcataagcacaaaggcaatgctgctaagcatactgataacaactaatttttttactttcacaatgctctctccttttcgatcaaatctctcgaaaagaggaaaggttctttacacctcaataaaaaaaccgcttttataaaaaagcgggagtttactaaggcttagcaaagaaacgtttgatatgagcatcaaaacgtctgctgaacctccatcttctcccatccagactatactgtcggctccggaatctcaccggatcctgccgccgaagcagctcgcgggcttagagtatgatactcatcaccgccggtagggaatttcaccctgccccgaagattgatcttatgaatttattcacattatatatgatcacattgcaattgtatagcgaactgctcaattttatataaaatattggcgaaactcattttttaactgaatgagcggtttccttttctcctttactgcgtcaatacgcattgacactctattgagaatatgataaattatcagatatttagtcagctaaactaggaggaaatctaacaatgtttcgagttttggtctcagataagatgagcaatgacggcttaaagccgctgatggaatcagactttatagaaattgttcaaaaaaacgtcgcggatgcagaagatgaattacatacctttgatgccctgttagtccgcagtgccacgaaagtaaccgaagaattgtttgaaaaaatgacctctttaaaaatcgtcggcagagccggtgtcggggtggataacatcgacatcgatgaggccacaaaacatggagttatcgtgataaatgcgccaaacggaaacacgatttcaacggcagagcatacattcgcgatgatttcttcattaatgagacacatcccgcaagccaatatctcagtaaaatctagagaatggaaccggacggcttttgtcggggcggaactctacggaaagactctgggaattatcggtctcggccggatcggaagcgagatcgcccagcgcgccagagcgttcggtatgacggttcatgtgttcgatccgttcttaaccgaagaaagagccggcaaaatcggggtaaacagccggaccttcgaagaagtgcttgaaagtgcggatatcattaccgttcacacgcctttaacaaaggaaacaaaaggactgcttaatagagagaccatcgccaaaacgaaaaaaggcgtccgccttattaactgcgcaagaggcggaatcattgatgaagcggcgcttttggaagcactggaaagcgggcatgtcgcaggcgctgcgcttgacgtgtttgaagtggagccgcctgttgaatctaaacttcccgaccatccgttagtgattgccacacctcacttaggcgcttcaacgaaagaagcacagctgaatgttgcggcgcaggtttctgaagaagtgcttcaatttgcaaaaggcctgcctgtcatgtcagcgatcaacctgccagcgatgacgaaggatgaattcaaaaaaattcagccttatcaccaaattgccgataaaatcggaagtctcgtgtcacaatgtatgaaggaacccgtcaaagatgttgcgattcaatatgaaggcaccatcgccaaatttgaaacatcgtttattacaaaaagcctgctgtccggcttcttaaaaccgcgtgtagactcaacggtcaatgaagtgaatgccggcggtgtcgcaaaagaacgcggaatcagcttcagcgaaaagatttcctccaatgaatcaggatatgataactgcatcagcgtaaaagtgaccggagaccggagcacctttacgttaacggctacgtatatccctcacttcggtgaaagaatcgttgaactgaacggctttaatattgacttacatcctgccggccacctcgtatatatccagcatcaggatacgactggcgtaatcggacgcgtcggacgcatcctcggcgataacgatatcaatatcgccaccatgcaggtaggccgtaaagaaaaaggcggagaagccattatgatgctttcttttgataaacacctggatgataaagtcgtcaatgagctggcttcaattcaggatattgtctcagttaaattgattgaccttccgtaacagacaaaaacccaaaacatataaatgttttgggtttttaacgtttaatggatgggaagcggattaggcgcggcaggcacagcgattggttttgtcacatcataattaccgactttctttgcacgcgcatgtgtgaacagcacctcagaaaaaccgaattccttcgcggttaacaaaagtccttcgatcattaaaatcccttctagcgaatcttccaccgtatgtttttcggacaattggatttgcagctgccggccgtttttattttcggatactgatgcaatcgcatctgcttcaatgacgcctgcggtctgtgagtctttatctgttttcattccgtcaatggcttgctctactgaagaataggtttgttccgacggaatgagatactcttgtcccagattgtcacggtaagaaaaatacgcccgttttgcctgcttatgtacggacatctcagcggcaataccgtatgctttataaagatcctgtcctgctccattttgaatctttgtcattttaatccgctcgtaaggactccaggtcaaagtctctttcagcacctttttcaataaatcagcttcggccactgattcaattgatagccgtccgtttacttgtacaagcagatccttcttatccgcacttacttgaacaccgtccaaaagccggggtacagacaggaaagattcgggcacttccaggttttctgcctcggataaagcctctgaaaccgattcgtcgggcttccttttttcaaaactgatcggaataacggcggatgtttctgaatcggcaaacgccaacgtaatgtatttgtttttgttttggtttgagacgacaaacgtcttctgttccggcttgactgaagctgactgactggctttttcagcctgactgctgtcagctgtaagatcaccggaagattcgtttcttgtcagcaggtgaggagatataatcagagcgatgcacaatgcgcagatggcggctgttgcggggccgatcctgcttcgggccggtttttttctatactgtttacccgtttcaatattccggtaaatggcctctggtgaacgatgatctctaaccgccggaagttgtcttaacaactcctctactctttcttcgttccaatatgacttcatcatccattagctcctccctcaaaagctccatctgtttccgaagtattttgagccctctgtgttgggtcgttttgactttgctttccgagaagccgagagcggcagctgtttcctgaatggaatatccctgaataaatctcaagataataacagctctttgatcaatggtgcagtgatcaagcgcggtataaatttcccggacattttcatgctgtacggcgagttcgtccggaagcaaatgctgatctctgacatcttgtgtatcccaatcaaacgtacccataatacgctgtctgatcgtctgctgcttgcggaaccagtcaatcgccacatggcgcgcgatggacaacagccatgttttttcactgcttctaccttcgaatgtatgataggaattcaagacgcggatatacacttcctgcgccaaatcctcagcctgtgttttatcttttaccatataaaataaaaattggtataaatcttgatgatatgcatcatataatatctgaaaggtttcttccatgggaagcccctccgttcacttttttgtcgtataaatgcgttgaaaagttacattacaactatattacgagaaactggaatttggaagggaatttatattaacatattcttaaatttttaaaggggaaattaacaaaaaaacacccgcatgttctgcgggtgtttcgtatggaacaagattgttcgtcaatttcagacgccatcctgcacttttgtcggaatataaaatgtaaacgccgtccctttgtcgatgctgctgtgcaccgcaattgagccgccgtgcgcttccacgatattttttacgatagcgagcccgagtccggttcccgccctgccccttgttctcgccttgtccgctttataaaaacgttcaaaaataaaaggcaggtcctcttcaggtattcccgagccggaatctttaatatcgattttcagtccgtcttttacggtctgagccgcgatatgaacgcttccgcctgactctgtatgacgcagcgcgttgtctataagattggtaaacacctgttccattttgtcttcgtcaaagacacactccggctgagacaccgcaatgtcttctgtgagcgaaacccctttttccttcgctaccccggaaaatttgcgggaaatcttctccagaaattcatgcaggttcaccgtttcatagtgcagacccgtatgtccggattccattctggccaagtccagcaagtcattgacaagccggcccatgcgaagggattcatcataaatgatctgcgcgatttcttttttctcctcttcggtacttgcaatgtcgtccactattgcctcactgtatccttgcagcatagaaatcggagttctgagttcatgactgacattggcaatgaaatcttcacgcaatttatcaagcctgcgctcttcggtcatgtcacggagcacggccacggcgccgcggacgtgtgattccgcataaagaggcgacatcaataaaacccatgaccttccttgaagcgtcatttcaatcatttgctctttttctgtgctcacggcattttgaaaaagctcttttgcttcaggaggaaggttgtctccttctttaatgttcatattctgctcgtaataccaagcctgcagaaaacgttcggccggcgggttcgtcaccaaaatggtgccgtcgatattaatggtgatgaccccgtctgccatactgcttaaaatattcgacagctgttctttttcctgattcagcgcgttgatatggaaattgagctgccggcccatctgattaaaggcaatggccagttccccgatttcatcttgagtcagaatcggaatttttgtatcaaacttccctttcgccaagtcctgggcgccttcccgcattttccgaagcgggtacgtcaccctgctggataaaaagaacgcgaaaaacgttgtcaaaacgatggcaattcccgccgcaagaaagatataccgtgtcgtatgtttcgtcgtatctttgacggcaagcagcgactgagataaaaagaccatgccttttttgccgtctttttcatacggcacgccgacgatcagccgttcgttatcggaaccggcatcattgggcgccgcgcgtttgcttacttttttgcggtctgtcagcgccttgtgcaaatcccggtcgcgtttgatctgctccaatgtaatagatgataaatgattatcgtcattcggcgaataccagacgtgctgatcatcctgaatgatcgcgatgctcgttaagttgtccgccagctcccacgtgatggatctggcaagcggctggtcttcatgattttctataatgaccgctattttatcggcaagctgcgttaaatctttttccgcttcttctacgtggtaattctctatgaattcgagaagcagcaccgttaaaataaataaaacaattaatacgagtgaaagaatggtaaaccaaagctttcctactacgcttttccaaaacttcattcagcgcctacctcaaatttgtaacccactccccagacggtgacgatttttttcgccgctcccggagatactttgtttaatttttcacggagccgttttacatgggtatccaccgttctaaggtctccgaaaaattcatactgccatacttcttttaaaagcttttctctgtcatacactttgtccggtgttttcgccagaaaatacagcagttcgtattccttcggcgtcaggctcacttccgtgccgtccgcagtcactctgtgagcatcgtgatcgatggaaagatgtgaaaaaacgagcacattttttgtcggcgtatttgctgtcagataggatgtttgagaagctcttcttaaaagcgcctttacccgaagcaccacttctctcgggctgaaaggcttcacgatataatcgtccgtacccgcttcaaacccctgaacgcggttggcttcttccccttttgccgtcagcatgataatcggcgtcgcttttttttctctgagctgccggcatacttctattccgtctgttcccggcatcattaaatccaagagcaccagatcataatctgaggccagccccattttaatggcctcatcgccgttttccgcttcttcaatcacatagttttcccgttcaaggtacattcttaaaaggcggcgaattctggcttcatcatctactactaatattttagtttcatttgtttgatccatcgttttccccctgctttccttctgttactttcattttaacaaactgtgcggcggcttgagaactgtatcggctttcggcatctatgcgtacgaatgaagtccggcaagcacgagatttacaaaaattaagttaaacataataatggcaaagccgatgacggcgagccatgccgatttttcgccatgccagcctcttgacagccgcaagtgcaagtatgctgcgtaaaataaaaaggtgatcagcgcccatacttccttagggtcccagccccaaaaacgcgtccatgcaagctgcgcccaaatcatcgcaaacacaagcgcgccgagtgtaaataccggaaatccgatggaaacggcgcggtagccgacttcatctaccaagtcgagattcacatttttgacgagcgggcttaaaagagcgctgattctctttctgaatatcagcctgagcgcgccgtataagacgagacctgcgccaaacgaccagatcaccgtattaacctttctgcctgaaaaaatggccgggagctcaacaaacggcttcattgcgccttctgtaagcagttctccttcatgcggaccgacaagcgcaggcatatcatataccatgacgcttttggcatcttttttatccacccaattaaattcggctttgtagtccgccagccggaatgccgacgtgacggcgataaatgccacggtcgtcacgaggataaacatgatgacttcgagccagaacgtttttttgcccggtctggactgatcgacatgctttaacaggaaaatgactccggctacaaagctgatcgcaagaatcgcctgcccgagcgccgccgtcgtgacgtgaatgtacagccaattgctttgcagtgacggaataagcggcgtaatgtcggtcggaaacatgcttgcgtatgcaataagcaacagcgcgatagacaatgtgaacatgcctaaagacggcagtctgtaaataaagtaaataataataaaagcgagaacaagcatcatgccgaatgacgtggtaaattcaaacatattgctgacaggcgcgtgtccgcttgccgaccacctcgcaatgaagtagccgagatggcaaataaatccgagaatggttaacgtgattccgattgccgaccagcggcccttaccgtcctttgcaccttttgttccccggatggcgccgccgaaaaccgggacggcaattaaataaatcaaaaaggcagcataaagaaaatttgcgctcagctccgccatgacaccactcctttttcattaggcctgatttttgaccagttctttttgatcggccggctctttaatcccggtcccgttaagaacatattcaatatcctttttcaaaccgaaccagtttttgttcgtatgacccgccacaagcacttcattttcaccggttttgatccagattcttctgtgctgccagtacattccttgaatgacgccgatcataaaaatcgcgccgccgacggcaagcacccataaggttaaatcttttctgacggtgagtcctgtaatgtttttcgtttccacgtggtcgaattttaatttgtacttgttattcgcggaaccttcaacagtctgctgaatcgcaacaaagcttttctcccctttcggcttgtcaggagccgtaactttaaagacaaaagccggattgttcggaaccttcgttttcgtgctcggttctccgtccttgttaaaataaaaatcaggaagataactggcgatctgcactttgtaaccgttaccaagatcatagtccgtgtctggatcaagaagattgatcttcagtctgccgaatgactgttttgttttttggtcgatcagctgaaacaccatctgatcgagctggttttctttatagtccacctgatacacggaataggagtcgaaccgcagcggttcattgacgcggatattgttttctttgactcttttaagcttcggcttttcaccgaatacaatgtcgccttccctcttgtacaaaattgcatccgtattgaaggatttggcgactttgccgtttccggctctgtcaatggcgtcggcgaatacttttttctcagtgtttttgttatatgtctgcatggtgaaccgattgtttttcaagtaatatttgccgtcagtgccgggaatctgggcggtttcgccttcacggacccagagggtttcatcgacatacatccccgggacaaacctcagcatggctccgatcagaaaaatgatcaggccgatatgattgacgtagggcccccaccttgaaaagcgccctttttccgccagaatgcttccctcttgttctcgcactctataatgcttttttttcaaacgtgttctgatgccatcagccgcctccgcgctcagaccggtttccgtccggctgtatagacgctgcctcttcaaaaagaccggattccgctgaactccttgatttttcagcgctctgtacagaggaatcacccgatccaggctgcagatgacaagtgatatgccgatggatgcgatcaggagcatataccaccatgaaccgtacaggtgatgaaatcccagcagataatagattttgccgattataccgtactgctgttcataatatgtatccggctgggcgcccggcggcagataagcttcctgcggaaaaaccgtgccgaatgctgaagccgccagagtaatgacgatcagccatattccgactttaacggaagaaaagaaattccatactttatctacgattgttttgttatatgtttgcgaacgtcttgcgctgccgtcgtaccgcatatcggcaagcggcgacttttgatcatcaagaggcttcccgcacgactcgcacaaaactgttccggctggattcacgtgcccgcattcacatttgacctttttcatgaagacgcctccggcttaattaaattcatatagtcatgaaccatgcgttctgtcatcgtgccggtcaccactttcacgacttttccgtcgggattgatcaaaaaagtcgtcggtataggcgatacgccgtacgcgtccagcacttgccggtcagtatcaagcgcaaccgggaaattgacgccgtatgttttcataaaattatgtactgcaatttttgattcgccgacatttaccgcaaccacctctacaccgaggtctttaaaatacttatattggttttccatataggggaattcctgcttgcaaggctcgcaccacgttccccagaaattcagaaaaacaccttttccttttaactgactcagttctatgtttctgccctctgtatctttcagcgcgaaattcggggctttggacccctcagatatacgctcgccgtttgtgtaaacagcgttatagatggtatatccgagcgcgcagagtaagatgagaaggatgccggtccgaatgaataaacgccgccgttttttgttcattgtacactgctcccctcccctgcctgcaaatccattcaattatatcatcttcacgttttgtaatttttgaaggttatgtgaaaattagaaagcgtttttaccgtggtcggctaaagcccgcagccttttcacctcatgcggcgtcaattctcttgcgtctcctgtgtgaaggcctcttaaatctaaaaatgcgtattcttcacgtttgagtttcagcacgtcatgaccgatcgcctcgaacatgcggcggacctgtctgtttcggccttcatgaatcgtcagctgaatgatgctcgtctgctttcttttgtccagggaaagcattttcgctctggccggagccgtcttgccttcttcaagctgaatgccgcgctcaagctttctcagaagttccttggaaggaatccctttcactttggcgacgtatgtcttatcaatttcgtatttcggatgcataagtttgttggcaaactcgccgtcatttgtcagcaataaaagaccgctcgtatcataatcaagcctgccgatcggataaatgcgctgcggcacttctttaaagaagtcggtcaccactttccgccctttgtcgtcgtcagctgctgagatcactcctctcggtttataaagcagaaagtacacgggttcttcccgttccacctttaatccgtttacttcaatctgatcagaaccggtcacttttacgccgagctctgttattacttttccattcacctttacttttccttcttttatcagctcttctgcctttctgcgtgatgccacgccggcatgagcaataactttttgcagtctttccatgtcgttcacctcaagtataatcttacttttttccacttgaacaaacaagctttttcaaggagagttattctgatatataaaaagcgcctgattcaggcgcttccaaataataacgtaactatgatgattgatgcaaccactccgatcaaatcagcaagaagaccgacctttagagcatcccccatttttttaatgccgaccgccccgaagtataccgtcaggacgtacagcgtcgtatcagtcgatccctgcatgacagaagccagtctgccgataaatgaatcaggcccgtacacggcgatcaaatctgtcgtcatcccgagcgccgccgtacctgaaatcggacggatcagagcaagcggcacgacctctgccggaatgccgagcgccgtaaagaaaggcttgcaaagtcccatgacaaaatccagcgcgcctgaagcccggaatacggtgatcgccacaagcatcccgaccaaaaacggaatgatggaaaacgcaatctcaattccttcttttccgccttcaacgaatgattcatacgtcggcacttttttgatcgtgccgtatatcaatataccggcgataataatcgggatcatggctaaagacagccaattcaccatttccattcgcttacctcccttttcttttgcggcggtaccagaagtagcggtcaatgaaaattgcgccgattcccgaaattaaagtcgctaagatggtcggtccgacgatatcggtcggtgatttcgccgaataagccatgcggacggcaatgacggttgtcggtatcaatgtaatgctcgaagtatttaccgccaaaaaggtaatcatggaacggctggcctcagacttgttgccgttcagctttttcatctgctccatagctttaatgccgaggggtgtcgcagcatttcccaacccgaaaaaattcgccatgagatttgataagatgtatcccatagccggatgatcagggggaatatcgggaaacagcttagaaataaacgggcggcacattctgctgaatatatccaaaaggccggactgctcggctattttcatcaggccgagccagaacacgaggacgctcattaatccgaacgagatcgtaacagcttctttcgctcctttaaaaacagcttcattcacatcctgcaaggtaccgttaaacatcgcaaaaacaagtccgattacagtcagacagacccagattaaattgaccatactgaaccgcccgccgtgctcataaaaaggctcgtaaatgtttcaatgaaatgctttttcggctttttatggcgctcattttcataatagacggggatcttggcgatcactttcccgtcatgcataacggtcatccggccgacaacatcaggaatgagagaggcatcctttttccaggcttttttcggttttattaaggttgtgctgattttcacatcatcgatttcatcctcttttaacaaatatttaacatcacgggtaataaaagcgtgttttccgtaaaacgtctttttcagcttcgggatgccgccttttttggcgacgacataggttttatagttctcaaagacataattaaacatattcatatggtcatcccagtcatccggatcattaatagtgactgcgatgagatccgttccgtcttttgaagccgtcgaaacgagggtccgtttcgcgatttttgtgtaacccgtttttccgccagtgctgtaaggatagagccctgtcaaaagcttgtttttatttttccacacccggtccatcgtttccgctttatacacttttgtgcctgaaacggtccggtattccttgatcttcatcgcgtatttggtcaaaagcgccatgtcatacgccgttgaatataaattttcgtggtcatccagtccgtgcgggttttgaaattttgtattttccatcccgatttgctcggctttttggttcatcataaatacaaaaccgtcaaggcttccgccgacatattcggctattgccgcagcggcatcatttcctgatctcagcataagcccgtatacgagatctttcagcttaactttctgtcccggctgaagataaattgctgaaccttccgtttttacggcattcggggaaacagtcacggtcttttccatcttccctgattcaattgccagcaccgccgtcatgattttagtaatgcttgcgatccgccgcttatgatgttcgtccttagcgaataataccctgcctgatgttccgtcaattaaaatcgcgctttttgcgctgacatgtatttgggcatgtgccgtatttccgtctgtaatggaaaaaaggataacaaaagtcaaaagaaatacggcagcttttttgagaaagcgcatgaatgctcacgtccttgttgtgggtttgtacaagtttatgcgcatgtccatgacttatgaataccaattacatcactttacataaaaaaactctcccaaaagggagagtttttatctggctgataccatatttgagcctgatgcttcatattgcgccaattcttcccgcatgcgcagaaactcactgctgagcgaaagcagaaggctccgcagcgagtccggcactcgctggtaaaattcaatcgcgctttggcctgtatatgcggcgcggctgttttcataccatgtatcctttttcggcatgaaaaactcttccacgcactgatgatacactttatacagggttttctccgctctcgactcatgaaacggctcctgcattaagagccggcggcaggcttcctgggcgccttcgcaaaagacggtcatccgtctcagcacactgagcacatcgcggcagtatgcctcatccgcctttcccgaagcctgcatctccggtaatgttgtatgatttaaatagctgctgaccatcgtgacaacctcggctaaaaatttaccagtttcttcagtatgggccctcacaatcgaatttcccattttcgtccgtttccttcctctcttgtacttcgtcaatgtgcgtcattcatcaatggcctttccctactatcgtatgatgaaaaaccgttattatttaatatcctcaaaagtttggttgaagttttcaaagaacaagtcggcttcctcctggagaacgtcttcttccgcattttcaggaagcggcgggagctcgtccagtgtttttaagccgaattgttcaagaaatacaggtgtcgtgccgtataaaatcgcacggccgggaccgtcggcgcggccaacctcacacagcagcgcttttgacacgaggctgtgcagaatccgttcagacttcacgccccggatatcttcaatttctgcccgtgtgatcggctgcttgtacgaaacaatcgccagcacttctaaagaagcctgtgacagcccctttgacggcacttcgattaatttttttaaataaggcacgaattcttttttcgttccaagcatatacgtatccgcatattcggtcagctcgatacccctgccgtcttccttgtactgtgcggccacttcttccataattccggccagctccgcttcttctatttcaagcaccgtcaccaattgctttttggtaagcccctcatcacccgccgcatacagcagggcttccacaatcgctttccaattcacgatatcaagcgccatgaatggattcactccccgtaatgtatatatctgaaaagttttcttcctgttcaaggataatctgctgatttttcatcagctccagaactgctaaaaacgtcacgacgagatggtctttttgccgagaaggaaaaagctccgtgaagtttattcttcttcccgccgtttttaaactttttacgatttcgttcattctgtcttcaatcggtatttcctgtcttgtaatggtcgtttctttcggccgcgtgatttttttacgctgaagcactttttgaaacgcgccgatcatgtcataaacggtcaccgaaagcttctgctccgtctgtttgatttcttttgcatattcacttaaatcactcggcggcttcgtaaatgacttttgtctttcttcttcccgctcttttaaatctttcgcagcggttttatattttctatactcaatcagcttttcaatcagctcgtcccgagggtcttcttcttcaagcatttcgtcttcaaacagctcttcctcttgtttcggaagcagcattcggcttttaatgctgagaagagtcgccgccatgaccagatattcactggcgacatcaagttcaagcacttgcattgtatgtacatataataaatattgttcagtaatggttgccacgggtatgtcgtatatgtcgatttcaagacggttaatcagatgaagcagcaggtccaatgggccttcaaacgtatcaattttcacttgatattctaccattatctcaccattttcaatatcactctcattgccggaaaaactggctacccattagtataatccaccgaaatgctcgcgtccaatacttttctaatcgtgctccgttatttagaaaatactgaaaaagaagatatacgcctatacctttaaaggcggatgcacatatgatagccgtgtaaacatgaaacaaagggaggctgatttcacatgggcggagcttgtttcggcggaggatttgcattaattgtcgttctgtttatattgctcgttgtcgtaggggcatcttacatctgctagttcatcaggcttcagacaccaagccgctcttttttccttttcatagcgctgtggtacactgggtttagcataaaaggaggaagcggcttgtatccaaaagcttatatcggctttttggccgaatttcacgcatcaagagattattttgagtgtcatgaactgttagaggaatattggaaagaaagcccgcctggggagcggagcattcattgggtcggcctgattcagcttgccgtcgctctgtatcaccagcgaagggggaatgaagccggggctaaacggctgattgccaacagcttacgtattctgcggtctgaaaaacaggctgtcagctctctcggtctcagtcatccgaagctgattgagctgatagaatcgctgtcagacaacatagaagcgggcctgccgtacaaaagtgttatgctgccgattacagatgaaactttgaaagaagcatgtcttgccgaatgccgccgcaagggctatatatgggggcaagacggtgtatccgatacctttcttattcataaacaccgcctgcgggacaggacggatgtcatcatggaacgcgaacgggaaattgagaaaagaaaaaaaagcagaggctgacggtcagccctgctttttctatataaaaacagctcccgaaaccgtgatgattccgggagcatttgtcagttattatatgaaatatcctgatctttttgatgttgacagcgttcaaaaaagctttgcgttaattcattcggaacgagtgcctccgttttgaacagacgttttaaggcgtccatcatttgctttccgattccttgatggcggtgagaaggattcacgctgatatgacggatttcaacctccgagtcttttttttcgactccgatcgctccgacgatatcttcatcctctttccaaagaaagagctggcggccagtatccgtttcatagtccttcattgtctgctgaagctgcttaagatctttttcattcggcataaatgacagaagacccatcgcaatcttttcaaacgattttttataacgaattaacataaaaacccctctatatccaaaatgtccattcatgtcctatcaaacggatacataaaggcgatccgttttctcacattatatcattttcgccgcggttttaaacgcttttcaacaaattattcaaatgagcggtttaaatttgccatttcaatggcggatactgcgcagtccgctcccttatttccggcttttgttccggcgcgttcgatagcctgctcaatggtttcagtcgtcacgatgccgaagataaccgggacgcccgtcgccgttcccgcctgagcgatgccttttgccgcttcgttgcagacatagtcataatgcgttgtcgctcctctgatcaccgtgccaagtgtaatgacggcatcgtattttttcgtttccgccattttttttgcggcaaacgggatttcaaacgctcccggcacccaagcgacatcaatgtcatttgattctacaccgtggcgaatcaatgtgtcttctgctccgcttaacagcttgctcgtaataaattcattaaatctgccgacgacgattccgattttaagtcctgttcctactaggtttccttgtatgatattcatatgttatccatccttttttgtgagatttgtttttagaaatgaagcaagtgtccgagttttttcattttggtttgtaaatactgcttgttgtgctcactcgcttccatttgaagcggcacccgatctgaaatgcttagtccgtacccttcaaggccggcgattttccgggggttattggttaaaagtttcatatgctgaacccctaaatcgcggagaatctgggcgccgatgccatagttgcgcaagtcaggcagaaagccgagcgcttcgttcgcttcaaccgtgtcgtacccttgttcctgcaatcgatacgctttcagcttattgatgagaccgattcctctgccttcctgacgcaaatacaatagaacgccgcggccttcttcggcaatttgcgcaagcgcggcatgaagctgaggcccgcaatcacagcggtgggatgcaaacacatcgccggtcaggcattctgagtgcactctgacaagaacgggtccgctgttaaacgggacatcgcccatgacaaaggcgagatgttcttttccgtccacctcgtttgtatatccgtaaacccggaacgtgccgaagtcagtcggcagcgtaatgtcaacttctctgttcacaagtgttgtaatgttgtagcggtattctattaagtcttttatcgtaatcattttcagctggtggcgtttggcgatctcggctaactctggcactctggccattgtgccgtcttcattcataatttcacaaatgacgcccgctccttgagaaccgcatgcttttgcaaggtcaacggctgcttccgtgtggcccgcccgcttcaggacgcctcctttttttgcgattaagggaaaaatatgacccggacgctgaaaatcgtcaggcacagattcttcgtccaaaagcgcctgaatcgtaaaggaacgttcctgagcgctgattcccgtttttgtcagcttgtggtcaatgctgactgtaaacgcggtctcatgtgagtctgtattatgatcgaccattggatgaagatccagccggccggcgatgtcttcagaaagcggcgtgcagatcaggcctctcccgtgggtcgccataaaattcaccacttcaggcgtagcatgctcagcgagcgctacgaaatctccttcgttttctctgtcttcatcatcgacaacgatgatgacttcaccttttttcagcgcttctaatgcctcttctatcggatgaaacatattgatctccctttctaaaagccgttctcgcttaaaaaggcttctgtgatagtttgattgcttttcgtttgttctgttttgtgcaaaaagcggtataagtatttgccgatcatgtcgcactcaatattgacgatcgagccgactgctttcgtccggaaaatcgtttctgagatggtatgcggaatgacagataccgtcacactttcgtctgataagccgaaaatcgtcaggctcacgccgtctaccgtaatcgaacctttcaatacgagcgttttcgtcaattcgggagacagctttaagtcgtaatagaccgcgttgctttttttctcgatccgtgtaatttccgccgtcccgtctacgtgccctgatacaaagtggccgccgaaccgtccgttggcggacattgctctttccagattcactttactgccttttgacaagccgttcagcgaagtggctttaactgtctccggcatgacatctaccgtaaattgattgtcagaaaatccggtcacggtcaggcagatgccgtttaccgcgatgctgtcgccaagcctcacatcacttgtcacttttgaagcggcaattgttaatgccatggaaaggcctgtctttttgattgcttggatcgtgcctgtttcttcaacgattcctgtaaacatcgtcaccatcctttccatctttaggtatggccgtcagttttatatccggcccgatttgggtaatttgtgtgaattgtaaatgggggacatctttcattgattgaaaaccttcaccggagatcaagctgggagcaagcgttcctccgattaatgtaggggcgaaatagaaatgaagctcgtcgaaacagcccgccttgacaaaacttccgtgtacagatgctcctccttccacataaacggacattatgccgttttcagcgagaatgctgagcacctcagggatgtgaatgcggtctgtttcaagcgtaaagacttttattccgagtgcggtcagccggtctttctttcggacgtcagaacctgcggctgtaaatatccatgtcggcgcagccccgtcagtgagcacatttgccgtttcaggaacggtcagctttgtatcgagaatgactctgaccggctgcttcaccgcatcggggagcctgcatgtcaggctcggattatcggctttgactgtgcctgctccgacaagaatgctttgatgcgatttcctgtattgctgggcatcaagccttgccgcctctgatgtaatccatttgctgtcaccggtttcagtcgctgttttcccgtcaaggcttgcggccgctttcaaggtgacatacggaagtccggtccgcatgaagtgaagaaacattttattcagctcttctgcctgttgcctgagaagccccgttttcacttcgatgcccgctgcttccagcattgtgatgccttttccggctacaagcggattgggatcttccacagcgataaacaccctttttatccctgatttcatgatcagttcggcacatggcggtgtttttccgtaatggctgcaaggctcaagcgtcacatacaaatcagcgccttttgcatggctgcctgccatattgatcgcgtgcacctcagcatgggcctctccgtattgcaagtgggcgcccattccgacgatctgtccgtttttgacgacgacggcgccgacaagaggattcggctgtgtctgtccttcaccgcgtctggcaagctctattgccgtattcatataatattcttccatcgttatccctcccttcttccacgcaatttggcgtcaaaaaagccccgaatgtttacacagttcggggctttaccagttttaatccataggaaataagactatacagtatgattattttttgcatagcttctctcatccttctcccatccagactttcactgtcggcttcagcttttcactgaatccaccgtatacagatgcatacgggtcacgggctgtaaagcgcaggagcgccttattaccgccggtcgggattttcacccagccccgaaggatacaatcaatatttttttgtccttatccgctattataacatcctttacgggaggcgcaatgaatttgcacctaattattcagaaaaaataaaaagcgccttttttccaaaaaggcgccttcatttattcgtttactttaacgaccttcaataagccgtcaatccggttcgatttgctgaaatacgctttaatcttatctccttttttcacatcggagagatcctgtttcagcttgtcgccgttaaaaatgatttttgtgccgtttgctgccgtaccgtggtattcatttccttctattttcgtaattttatatgttttcactgtatattcttctttttcctgagacagggtttgtccgatcgcagtaggcacgtctttcagttcaatatcgtttatgaccataaaaccgcccgccaataacagcagcagtacaagtaaaatggctgcttttgttttaattctttccatttttctacctccagcccgtatcaatctattcattactatgtcatattcctttttttcatgaatagaaaaccgttcttccctgcgtgagttattcatataacgattcataaagggaagatgtttcatgtatctgtaaaactttctatctattaaatagatatacgaatttatgttctgtttttgtgggtggaaagataaatttatataaaaaaagcagttttctctaaagaaaactgctcgtacggtttatttcgtcttgcgaatttcattaaacgggaagaagacgaattttgatgttcccgctatttgttttttcgtaaaaagaccgaggccgttgcggctgtccatagagtttctgcggttatcacccatgacgaaatatttgtcgtccggcactttcaccgggccgaagtcatccgtcagcgtgtcatagccgtcctgcttcgcttttttcttgtttgccgctaaatacggttcggacacttttttgccgttgatgtacagctgatcgtttttcatttgcaccgtgtcgccgggaagtccgataatccgtttgacatagtgctcgttttctccgttcaaaacgacgatctggccgcgtttgaagtcgcttatgtatttgaccgtcatattgacaaagattctctcacggtcatgcagagtcggttccattgattccccgtcaacgacataaggagcaaataaaaagttgcggatgagcactgccagaacgacagcgatgataatggctttcgcccaatcaagtacggcgctttttttagaagttttttctttttctgatttcaagtgatttcctcccattagccatggttgtttttattttaccatgaatccctgcacagagggcaaataagccccgcacctcatccatttttttcatttcacaagccggatctgctgattttacggtatttcacgaagcttccgatccgccaaatgcacaaatacacaaaagcaagctccattgttaaaacggcaaattccgccgcgtcaatgtttttgaaatattgactgagcacgatacggatcgcaataatcgcgataatgacatatttaaagtttttattccgtttggagtagacaaagccgtcttcccggatttcatatgcggtttgcgacagcataatgacgccaaataccgcgcctaacagtccggcgatggcgagctcccaaacagcgggaagatgaaacggctttcccggaatatgcatgagctggctgatgctgaacgaaaaaatgacggcgataatcacaagcgggagaatgatgccgaagccgccgcctttaatcggcctgtttccctttttcattctgaaccaaaaaataagtgcaataataataatgacaaataaaacggttgccaattgaaccaacgtttttacctcttttcattgttgtaatcggtcttttacactataccagagtgaccgctatagttcatatatgtattttttcatgatttacacatgagaattttcatatacataaaaaaacccgcctgaaaaggcgggttttccgtcattaaccttctacacggacttctttcattttgtctccgttagacatgtttttcgcgtgctctaaaccgcttgtcacttttccgaatacagtgtgaacgccgtttaaatgcggctgcggctcatgtacgatgaagaattggcttgaacccgtgtctttaccggcatgcgccattgataaagaaccggcttcgtgcttatgcgggttgccttctgtttcacatttgatcgtttttccgcttccgcccatgcctgtcccagtcggatctccgccttggctgacaaagcccggaatcacgcggtggaaaataacgccgtcataaaagcccgtattcgccaggttttcaaagttagcgactgtattaggcgcttcattcgggtaaagttcaaattcgattctgctgccgttttccatttcgatgtaaccagttttcattctcattcctacttccatatgttttttgtcaaagccttcttccacatgaattttcaattgtaagccggctttctttttgatattcttttgaaggaagatgcgtctgctcttcttttcgcggcttattataccataccttcagccggaaaacgaatctcccagcttccaaagaaagaaaatgaaaccagaacagcttcacagccgtctatgtaacggaactgcttcacgcagggcctcacaaaccgcttcaaaacggcatttgtgaaaagaaggaggttaaccgctttgaaaaaaatgtggattggattgctggcggcggccgttgtattgtgcacaataccgaagatcagcctggccgatgccgcagtcggagatgtcatcgtcacactgggagcagatctgtcaaacgcagaccgtcaaaaagtgcttgacgaattaaatgttcctgacaacgcgacaaaagtgacggtcactaataaagaagaacatgaatatctgggaaaatatatatcgaatgcccaaatcggcacaagagccatttcttcatcatccatcacggtggaaaagaaagggtccgggcttgacgtccaaacccataacatcgattccattacggatgaaatgtacttaaacgccctgatgacagcaggcgtgaaagatgcgaaagtatacgtaacggcgccgtttgaagtatcaggaaccgctgcattaacagggatcattaaggcatatgaagtttcatcagacaaagcgatttcagaagatgtaaaacaagtcgccaaccaagagcttgtcacaacatcaaaactcggagataaaatcggagataaaaacgcctccgcgcttatcgcaaacattaaagacgatttcgcgaaaaacggtgtgcccgatacaaaagaaggaatcgagaaaaaagtcgatgatgcggcatcaaaccttaacattacactgactgacgctcaaaaagaccagcttgtttcattgtttaataaaatgaaaaatgccaagattgattggggccaagtcggcaatcagcttgataaggctaaagacaaaatcacaaagttcattcaatccgacgaaggcaaaagctttattcaaaaagtcattgatttcttcgcgtcgatttggaatgcgatcgtgtctgtatttacaggagacagcggatcaagttctaacagctaaaacaaaaaagagaccgggactgtatcgtcccggtctctttttttgtttattgtttgactcccgtcttaaacggcagatccagcttgacaatgtcttcataggtttctcttttaatgacaagatgcgcttcgccgtcttccacaaatacaaccgcgggacgcggaatgcggttatagttgttagccatgctgtatccgtatgcccccgtgcagaaaacggcgagcagatcgccttctttcacttccggaaggtctatatcccagatgagcatatctccgctttcacagcacttacccgcgatggataccgttgtgtcatggtgttctgagattctgtttgccgatacggcttcatatttcgcctgataaagcgcaggacggatattgtcgctcatgcctccgtcaacggctgcatatttacgggtgccgggcacttctttttgcgaaccgatggtataaagcgtcgttccggcgtctccgacgagcgaacgtcccggttcaatccaaatttccggaatgtcaaaagcgtacagttctgcgttttcttttaccgcttcaataattttttccacgtagacggcgggatgaagaggttcatcctcttctgtgtagcggatgccgaagcctcctcctaaattcagcacttcagagacaaagccgaatgattctctccattcattcagttttgcaaagattttttccgcggccaggacaaagcccgccgtatcaaaaatttgcgatccgatatggcagtgaacgccgagaagacggatatggtctgactgtaatacttgctcaatcgccttttctatttgcccgttatgcagatcaaaaccgaatttggaatcttcctgccccgtcgtaatataatcatgcgtgtgcgcctctacccccggggtgatccgcagaagcacatccatggcgcgccctgatttgcggcacagttccgcaagtaaggatatttcatgaaaattatcaacgacgatgcagccgatttgatgatcgagcgccatttgcaattcttccctgcttttgttattgccgtgaaaatgtatccggtcagccggaaaaccggccgaaaccgccgtaaacagctctccgccggacacaacgtccaatgaaagcccctcctgctcagcgagctgtatcattgcaacggaagaaaatgccttgctcgcgtatgcgacctgcgcttttaaatccgcgtcaatgaatgcctgtttaaagcttttagcgcgctcacgtattaaagccacgtcataaacataaagaggcgtgccgtaatgctccgctaaatacagcgcatccacacctccgatttccagatgacctagtttgttttgtctgcttgtgccatgtaagaacaatgctcattccctctttctgatccgcatatgggtgaaaaggacagcttttgttgagctgtccttatacaggtcccgtataagttaagacatacaatatcataatcttctgtcggtttcaatgcgattatgaaccgcttggctgtctttgacggtctttcgggtgaacaatgctcggtctgacttttgctcccggcactgtcgtccggacgagcacctgccacagcgccttgccgttaaatggtaaaaacggccataaatacggcgtatgaaatgagcggatactcgccattacgatcagcagcaatgtaaagccgataacaaagcctttcactttgaaaatggccacgagaatcattaagatgagacgcatcattttattggcgaggctgagttcatagctcggcgttgtgaatgatccgatggcggcgatcgatacgtacaaaatcacttcggctgaaaacagccccaccgctatggcgatttgtccgatcagcaccgccgcaatcagccccatggcggtcgataaagcggtcggcgtatggatcgcggccatcctgagaaactcaatgcccagatcggccaaaaagatttgcagaatgatcgggatatgcgtatttttatttaagccgataaaatccaatctttctggcagaagagacggttcgagaacaaacaggaaccaaatcggaagcaggacagttgaagcaataataccaaaaaacctgatccatcttaaaaatgtcccgacagaaggagcctgcctgtattcttccgcatgctgaacgtggtgaaaaatcgttgtgggcgttatgataacgctcggtgacgtatcgacgacgataatgacgtgaccttccaaaatatgattggcggccacatccgggcgttctgtgtatctgaccataggaaacgggttgtagccctgcttgacgataaattcttccaccgttttatcagccatcgtcagcccgtcaatgtcaatcgcattcacttcgttttcgacgatgctgacaagatcagggtccgcgatgtcctctatatacacaatggccagatcggtcttagagcgctcaccgactttcgtaattttgacgcggagcctttcgtctctgattcttcttctgatcaacgctgtattaatgacgatactttctataaaaccgtctcttgccccgcgcacgaccttttctgtatccggttcttcgggcgtgcgtccgggataattcctgacgtcgacgacgaaagcgaagccggcgtcttcaacgataacggcgacaagtccggaaagcacttgatccgttgcttcgtcgagtgttttcactttttggacctgctgattgacgagcctgttttcaacgacatcaatcgcttcatccgcgttctcgtcataattattgacatcgacgagctgctctattaaatgaatgataaacaaagtatcggttaacccgttgacaaagtaaatctggacttcccggcctaaaacttgaactttgcggacgccgacatcatagctcgtccccataccgacacggtctttaaaaaattgttcattttttctaggatcccggtatacttttatcatgttttccggtttttccggcatgatattcgctcctttctaaaatgaattcgacagccttcatcgtaatcggcgagcctttggatatatcatcttttcttcccatctttcctatgtcgccgatgcctacaatgaggggaacgtccagtttgtcaagacaatacaccgtgtctccgttcattctgtgctcgtccatttctctcattccgattttgtcgacgccaaactccgtcacttctccatcacggtcaatggagacatctactttcgtccattcagcctgatgggttttagaagcgaccgcaatcactcccagcacttcaatgtcttgatgtgaggcgacatatttcagcgccgtttcgcccggtccttcaccttgcaggcccgaatcgtcaaacatgacaaacaccgggtcattcggcgcggttttaatcagctgaacaagttccggaccgcttctggttgaaggattgccctttgattgggaaatacaccgtccgcctgttttttccgcggcatattcaatcgttttggcggcgtatacgtccccgtctgtcacaaggatgactttccgtttcgtcatcagacattatcctttcggtttaaaaataacagccacaagaaatgcgaataaaatcgctgaagatatgccggcggaggtaagttcaaaaatccccatgccgatcccgataaatccatgctcgtgagcttgatgcatggcgccgtgcaataagctgtgtccgaagctgacgatgggaaccgtcgcgcccgcgcctgcgaactcgataaatttgtcataaatgccgaacccgtctaataaggtgccgatgaccacaaaagttgtcatcacatgggcgggtgtcagtttaaaaatgtccagcagcagctgaccgataatacaaatgattcctccgcaaacaaaagccaacagatattccatttatgatgcacctcccgctcgctcaaataccacaccgtgggcgatggtcggaatggtttccttctgctgaatcattgtcggacttaaaagcgctcctgtcgcgacaacgagaaccctgttgagagaccccgcttttaattgattaaaaatatgtgtgtacgtaacaagcgcggagcaggcgcagccgcttccgcccgcaaatacctgctgatccggcgtatagatgagaagaccgcagtcatcgtgtttcgttccggcgggatagccttcttctttaagcaaatcttttaaaatcggcgagccgacgcctgaaaggtctcccgttaaaatcagatcgtaatcatccgccgtacggttcaagtccttcaggtgctgtttgattgtatctgcagcagcgggcgccatggcagagcccatatcaaacgggtctgtaatcccgaggtcgcttacttttcccactgtcgcgcttgtaatcttgatatcagaagggttttggctgatgatgaccgcccctccccccgtaaccgttgaagtggcggtatccggtttttgcccgccatactccgtcggattacggaattgccgttctgccgtcgcattatggctgctcgtggccgcaatcgccctgttcgcaaaaccgccgtcaatgagtgcggatgcgacggcaaccgtttccattgacgtcgagcaggcgccgaacagacagaggaacggaattttcagatgtcttgcgacgtaattggccgtcacattttgatttaaaagatcacctgcgagcaacaaatcaatatcgctttttttcaggttttgtttttgcaaagcggagttgatggcatcttccattaattgacgttccgccatttcccagtttttctgattgcaatgcatttcatcgtatgtcttatcaaacagcgagccgagcgggccgtctttttctttcggtccggctgccgtccccgccgcatttataaataacgggttttcaaacacccaggtttgctttccggtcaatttcattttttctcctcctatgaaaacagtttttcacaagcaaaccgtatcaggcctacgatataggccgccacgacgccgaatacaatgacgtttcccgccaatttaaacatgtttgtcgccactccgagcacaagcccttcacttctgtgttccagagccgcgcttgtcatactgtttgcaaatcccgtcaccggcacggctgaacccgctccggcaaattgaccgagtctgtcataaatgccgaatccggtcagcagggctgaaattaaaataagagtggcggacgtcgggttgcccgctgttttttcgttaaaattaaaaaagtggatgtaaaaatcttgaagagcctgcccgatcagacagatcaaaccgccgatcagaaaagctttgacacaattccagacatatggcggtttcggctgatagtctttcacttttgttttgtaattttcttttaagtttgtcacgtctgttcctccttatgaatgatggataaaatacagccaatgaaataaagagccggctattttgccgaacacaatggccatcagcaaaatgatgattttgctgccgaagccgatccgtttggcaagaatgggaagcacattcagcacttctgtaagcgcggcggccagcatgccgataaacatgccggccaaaagcccgaccggaacggctagccattcagataaaaaaaaatgattcatatttaaggtttcccagccgccaaacacagcccctgaaataacagccccttcgtaggcctgtacaaagcgcattgtttttgtcagctgcataaggcgggggacgattcccataacggttaaaaaagccacaaagcccgctcccacggtcagcccgccgccaagcccgacaaatataacgaaaagaatgctaacgatcatgcagatctttcatcgtttcttcattttcgtgcattgcgacataatgatcgagatcaagctgataattaaacatctcgacctccagcgggcttggctcttcattcaggcgttttttgaagatgtgattgaaaaagacgatcataccgagaccgaggccgatgctgtacggaatctgaagcagatacggatattcattccgtctgcccgttatgatttcatataaggcgatatgaacttctctcatactcacatcttcatgaaaattcataatggcgagacatgaaccgataaaaagcagcagccagacaccgacaaacaaaacggctgacagctgctttttctggtaatgaatttccactatcgtttcagcgccgccgacggtctgtacatcaagagcgggaaaagcggtatgaatggccttcagcacttttataatgtccagcactacgatatttttgtcttttttcgtgatctgatacagcggcagtgccgacagtttttttttcagcttttgctgtcccgcgatctgcgcggcgtcgccgactgtgatgatatctccggtatgagccttcacgcggtggcgaagtctgaggaatattcgtctttccatcttgcatcaccatctttcgggtggttatatatgtagtatgtggttcacttttgttctcattcatcagcggcaaaagaccataaattaccacttgtgcacaaataaaaaaagccggcccgtaaaaggtcagctttccgtatgatccatctgcactttaatctgctttaatatttttttctccagcctcgatacctggacttgtgaaatcccgagccgttcggctacttccgactgggtctggtctttgtaatacctcagatagacaatgagtttttcccgttcttccaaatcactgatcgcttccttgagggcgattttgtcaaaccacttctcttctgaatgatcggcgatctgatcgagcagggtgatcgggtctccgtcattttcatataccgtctcatgaatggatgaaggcgcccgcaccgcttcctgcgcaagcaccacatcctccgcatcaatttctaaatgatccgcgatttcctgaacggtcggcactcttccgtatgtttttgacagctcatctttcgcccggcggattttattgcccagttcttttaaagatcttgacactttgacggttccgtcatcacggatgaagcgctggatttctccgataatcatcggcacggcataagttgaaaaacggacatcataggacaaatcgaatttatcaacggattttaacaatccgatacagccgatctgaaacagatcgtccggctcatagcctctgtttaaaaacctttgcacgacagaccacacaagacgcatgtttttttctatgaggaggtctcttgcctgctggtcgccctcttggctctttttgattaattctttgacttcatggtccttgagctgcgcgtttttgctgtttttcttaacctccacatccataacaaatctccttaattacaaagcgctttgctttttgataggtgttttgttaagcgtatcgtcgtccccatctccggcgaggaatcaatcgtgacatcatccatgaagttttccataatggtaaagcccattccggagcgctcaagctcgggttttgtcgtaaagagcggctggcgcgcctcctccagatccgtgatcccgaggccttcatcccgtatggtcagatagacgacgtgatcctccagcgtgacggagatgtacacctttccgtcgcagttttcttcatagccgtggatgatcgcgtttgttaccgcttctgatacgacggttttgatttccgtcagctcgtccatcgtcgggtccagctgtgcgataaaagaagcaaccgttacacgcgcaaacgattcattctgactgagggctgaaaattcaagatgcatctcgtttttcatgatgccacccccagcgttaaaagcgctttttgttctgattgttcgaacctgataattttaaacaggcccgacatgtcaaacagacgtctcaccgcaggcgaaatcgcgcacacgaccatttctccgccgagctgtttaatttgtttataacgtcctaaaatcacgccgaggcccgagctgtccatgaaggaaagatcttcaaggttcagcacgatgtgacggatgccgtcagcctccagcgattcagtcaccttttgttttaatgattctgccgtatggtggtcaagttcacctgttaatcgaatacaaagcacggattctttgacatgaaagtcaattccaaggctcatgctcattcctccttgatatgatcggataatgagtgtttcgattttcgggaaagcaattccttcactatgacaaaactagtgcccattcgccacgattatttaaattttgtccaatctcccatcgtccgcttcagaaaagtgagaaaacccgctttttccatgtcgtcttttgccgtgacggggctttcaacgagcacttttccgtcttttttcagaacgaggctgccaagcacctctccttttttaaccggagccgttacattgctgttgattttcacttcttttttaactttgtccatattctccccctttttggctaaaagggaaatcggttcagacgtggtcagcttgatcagtttctgcttaccttttttgactttgaccgatccgacgatttgattccgtttatacaatggatgtgttttgaactggctgaaggcataatcaagcatttttgtcacttgggcatttctttctttcggagtgctggctccgaaaacgactgcgatgaccctcatattgccttttttagcggtggcagttaaacaatacttcgcttcgcctgtaaagccggttttcacaccgtctacacccggataaaatttgatcagccggtttgtattgacgagccagaactttttgtctgtattttctcttaaataatcctcatacgttcccgtaaattgagtgattttgtcatacttcaataattccttcgccatttttgccatgtcgtaagcagagctgtaatggcctttttcaggcaggcctgtcgggtttttgaaggaggtatctttcaatcccaattcttttgcttttttgttcatccggctgacgaaatcctcttccgaaccggcgatatattctgccatcgcgacagatgcgtcatttccggaagcgatcgcaattcctttgagcatttcttttaccgtcatttcctctccgggttcaaggaaaatctgcgagccgcccatggacgcggcatgttcactcgtcctgactttatcgctcatcttaatgtttcctttgtcaagcgcttccatgattaaaagcatggtcatgatttttgtcatgcttgccggcgccaggcgctcccggctgttcttattgtaaagaatgcttcccgtatcgcgttcaatcagcacggcgcttttggcttcatgagcgagctccgatgtatgttttccgtccggctttgcaaaagcggacggtgccgatgcggttaataaaatgccaatcaacaaagtggatataagacgtttcatctccaaagccctccatttcataatcctttttattttttccaagcccggtggttttatacgcctcatctggaaaatgtttcgttttgagggcacaaaaaaacagctgctcccgaagaaacagctgcctgatgtttatttatttttgagatcgtgcgactacggcttttacaagcttcaaaaagccgccttttactttttccgtcatttccatcacttcatcatgggataacggctggtcaagaataccggccgcagcgttggaaatgcatgagatgccgagaactcgcataccggcatggtttgcgacgataacttccggcacagtcgacatgccgacagcgtcagatcccatcgttcttaaaaaccgaacttctgccggcgtttcgtaagatggtcccgtaacagctgtatacacacctttttgaaccggaatgccaagctcatccgccgttttttcagccaagtttgacagctctttgtcataggcttctgacatgtccgggaatctgactccgaattcagcttcgttcggtccgattaacgggttggtgcccgtaaagttgatatggtcggtaataatcatcaaatcaccggcgcggaattcagtgttgataccgccggctgcgttcgtcacgatgagagattcaacgccgagcgccttcatcacgcggacgggaaacgttacctgatccattgagtagccttcatagtaatgaaagcggccctgcatcgcgataacctgtacaccttcaagcgtacccatcacaagctggccggcatggccttctaccgttgagaccggaaaatcaggaatcgtttcatatgtaagcttaacagctccttcaatttcatctgccaatactccgagccctgaccctaaaatcagaccgatcttcggtgtttctttcacgtgttctttaataaatgcagcagcacgttcgatcttttgtttcaaaaaaagtccccctactgtaatcttgataaaaagctttttccgtattccggcttttctgttttgaaattatccgcaatggttgcgccgatatcggcaaatgtatccgcaagcggcagttgttcagtgtgcttatgctttttgctgtagacaagaagcggcacatactcccgcgtgtggtctgtcccgtgatggacagggtcgttgccgtgatccgccgtaatgatgagcaggtcgtcttctttcattttttcaaacacttccggaagcctcgcgtcgaattcctcaagcgcttttccgtacccttccggatcacggcggtgtccgtacagcgcatcaaaatcaacgaggttggcaaagctcagacccgtaaaatcttcgccgatcgtttcaatgactttgtccatgccgtccatattagatactgtgcggcgtgacgaggtaatgccttctccatcataaatatcagaaattttgccgatggaaatgacgtcaaatccgctgtccttcattccgttcattaccgtgcggccgaacggtttgagggcataatcatggcggttcggcgtacgcgtgaagctgcccggttctccgacgaacggtcttgcgataatccggccgaccatgtatttcggatcaagcgtcagttctctggccgtctcacagatgctgtacagctcgtcaagcggaacgacatcttcgtgagccgcaatctgcaaaacggaatctgctgatgtataaacgatcagcgcacccgtttccatatgttctttaccgagctcgtccagaatcgccgttcctgaagccggcttatttccgatgattttccgtcccgaacgctgctcaagctcctgaagaagctcatccggaaatccttccgggaacactttaaacggtttttcaatataaaggcccataatctcccagtggcctgtcatcgtatctttcccgtttgacgcctcctgcattttaccgtagtacgcaagagggtgctccgttttttccactcccttaatgtctccgatcagtccgagaccgagctgagccatatggggcatatgtaaaccgttcatgtgctctgcgatatgtccgagcgtatttgcgcctatatcattaaaatcggccgcgtccggcgcttcaccgattccgacagaatccattacgatcaaaaatacacgtttatatttgtattcagacatcataaaagcctccttttcttccatctgtccattgtagcttacagaggtcagacaactcaagtataaaccgtttacattcttattgacaatgcccattcaaataataagaaccttctctgtattccgccaatccgacagaaaaaagccgcagcccctctggcagcggctcctaagcgcgcggatgatactgcttgtacacgtccttcagccttgttttcgacacatgcgtgtaaatttgcgtcgtggaaatatcggcatgtccgagcatctcctgtacggcgcgcaggtccgccccgttttcaagcaggtgcgttgcaaaagagtgccggagcgtgtgcggtgtcagttcttttttaatgcccgcctcaagtgcgatttttttcaggtttttccagaatccctgccggctgatctggcggccgtgatgattcagaaaaagtgcttcggtcacgtttttctttaataatttccctctggctttttcaatgtacgcttcgatcgcatgggaggcggcttcaccgatgggcacaatccgctctttccgcccttttccgaagcagcggacaaatcccatcgtcaaatggacatcagataatttcagctcgatcatctcgctgaccctgatacccgttacatacagcagttcaagcatggctttatccctgagaccgaacggactgtcaagcttaggcgtgtccaataaccgctctacttcttgcagcgccagcacttttggaagcgcccgctctgttttttgtgtttcaatatgtaccgaaggatctttatccgcggctttttcccttaacagaaactgatgaaaagaccggatcgacgccaaatgtctggcagacgtcttaccggattttccggagtcctttaaatgctttaaatattgaataatatgaagacgggtcacatcattccatgaagtgatctgaagggtttcagttaagaagagagaataacttttcagatcacgctcataggacatcatcgtattttgggacagccctctttcaaccctcacataatggatgaaatccttaatttgatccttcactcttgatctactccccgttttggtaaaaaaagatcaatcggccgaaccagccgtctttctcctcatgttccgttttggccactttgacggcggagccttccggtttatcgtaccgatgatagttttcatactctgaattcacccatatcatagcataatagaacagtgcggtaaaacctgtgaacagaataaacactttgatcgtatccgcggctgtttttatgaatctgcccatctttcgatcgatcctttctttggcggctgttagtacaccttatgccaatttcaaaggcttttatacataaaaacagcaaaaaaccctttcctgacagaaaaggttcataggcttttattctgtttcatcctcgcggcagcggtggcagattccgtgaaaagtcaatctatgatctttaattttaaatttccaatcacgttcaatcacttcttcaacgtcttcaagcagatcttcttcaatttcatcgacggctccgcactccatacacaccaagtgatgatgaaaatgggctgcgccttctttgcgaaggtcgtagcgggatacgccgtccccgaagttaattttatcaacgacttttaattctgttaataattctaatgtacggtatactgtagcgagaccaatttcaggagatttctcttttacgaggaggtatacatcttctgcgcttaaatggtcttcttcgttttcaagcagcactcttaccgttgcttcacgctgtggcgtaagcttgtagcttgacgagtgcagctgctttttaattcgatcaatacggttttccatgtctttccctcctacgccgcattccatgactcattataacaaaatacgcggagagttccaactataattattataaactgataaataaaagtattattttgtgataatcattctaaaatatgcgcgatgacagcttttccataaacaccggagacacgtaggcttccagcagcgaagcgatgactgagaagaacacgataagaatcagcacgaaggcgtagcgtccgaaccattggatcggcgcgtcatgaaggctgcgtttgacaaacagctgccggatcagtttcagcgaaaaagcgatggagcatgtccccatgataaggtatgccggaatgagaacgatgttttgcggcagcaccgaaatgaatgacaggaaaaatccgttcatccccatttgattcactaaaaatccgaccgtgaagccgacgacgattcctttcaaaaacaccataatgaaaataaccggaagaccgataacggaaatgccgaggatccacatcagacccaaatattttacatcatgaaagacggcctgccaaaacatttctgaagagcccgcatgttttccgtcagacagctgtccgaaaaacttgcttaaatagtaatacaaatcttctttctgcgtgatggtcatgctgttgacaatgattgcgccgaaaatgacgcccattaaaaacaaaacgaacacaaatatataaagtgacagatgatcctttacatggcgaaaaaacagttctttgtacgattgttttctcataccgctttcctcccgctaatctattgacttgatttagtagattgtatgaaagaaaagagaaaacatgacagagaatcatagaaaggcgcgagattccggcataaaaaaagaacccccgtcatcactccggtgatcacaggggttcctttttttatgttttattctttccagcctgtcttttttcgtttttgtcactctttcatgcgtgctgaaggacggcgcctccccccttgacaagactgcgtcacgcattccgtttcttctgagatgctcccgcatttttttcgctttgctcttcgccatgtgccgatcgctccttttccttttctctatcataacaaaaaaatccaagtgcgttcatgaatacggcttatgtttcgtccggtaagcgcgcagagacgttttggcagatgaaaagctcccgatcgcggcgtatccgtaaaagaatcccataaaaatccccgcatacacgtgttcgtggtgaccgaaaacgatagacacaacatttccgacaacaagggcaatcgtaggaacgaatatgccaggaacccggcagaacactttgatcagctgtgtgacgcataagacgatcggcacgccgatcacagcatcccaaatatttgtatggatcagcggaaaataatccacattgacacctctttactccgtcttttgctttctgttagcctgccaaagaattccgcttcctattcatataaaaaaacagcaccggacacatatccggtgctgcaagcattatttattttcccgccgcggcccgttctacggctgctgatacggcccgatgcacgtccgcgtccaaaggctgaggcacgagatcaccgtgtttcgtgcaagaggcgatggcttctgcggccgccacaagcatttcatggtcaattttcttgcttttagcgttcagcgcgccgcggaaaatacccgggaagccgagaacattattgactgaacggccgtcggctgcataggcggctccggcttgtaatgcctcttccggttcaatttccggtttcgggttagataaggccagaataacttgtccctttctgacatcttcttttttaattagacccggaactccggtagtgctgatcacgatgtcacacgtgtccattaaatccttgatgcttccgagcggctgacctccgtattgagcgaggcggttcattgcgtcttccgacttgtccgttccgcagaccgctttgaccccgtatgccataaacatgcggcagatggcgacgcctgccgcgccgagaccgatctgtccgaccttcgcttcttttaaatcaaggccggcgcttttacaagcggaaatggcggcagcgagagtgacgactgccgtgccgtgctggtcatcgtgcataaccggaatgtccaattcttccttcaggcggtcctcaatgtcaaagcagtgaggcgaaccgatatcttcaagcagaattccgctgaaccccggagaaatatgttttaccgtgcgaatgatttcttccggatcggaagtatcgagcaaaatcggaattccgctgatgcctgccagctggtcaaaaagcgctgctttcccttccattacgggcattccggcgacagagccgatattgccgagaccgagaatcgcagtaccgtcggtgacaatggcgacagaattgctgattgtcgtatagatggacgctttttcaggctccttttcgatcagtctgcacacatcagcgacgcccggtgtataaacacggccaagctcagccaatgttcggatcggcattttgctcttcatctgaattttcccgccttcatgggcagagagcacttcatctgagactgtgtgaagccggatgccttcaccgagagcttcaatggcttgaatgatttcctgcagctgctcctcattttcggcctgcaccgtaatgttgcgcatcgtgtagttcgggccgacttttacggtttcaacttccccgatatctccgcccatcactccgatggcggttgccacttttccgagatttccgggaacagtcggcgtttcaatcattaaagtccgaatcatatgctttgtaatcatgaaatgaacctcctaacccaatttttgagattgcatggatttttctttcgtataccaaatgaattttccagtgtatccgtacaatattgccagtccgatagacacgaaactgagccacatgaacggcagataagaaaatgtggatactccgagaatgccggccatataaattccgttgtcagaccacggcaccatccctgaagtaagcgtaccgcccacctctgcgttccgggataaaattcttctgtcaagtttcagtttatcataactgttctccatgatttttggcgtcagaatcaatgacacatacatcgcacagccgaaaatgtttcctaaaagagcgacgatcaacgtcgaaagcgttacatttcccggtgtggtcagttttttctcaaaagttgagacaatcacttttaatacgccgagcttttcaagaattcctccaaaaccgagaccgaacaggataacgaccaacgtatccagcataccggtgatacccccgcggtttaacaggccattcagaaattcgacgtccgttttaatggaaaaaccattataagcagtcgcgatggcactggcaaaattcattccttgaaacacagaggcccagattgcgccaagcaaagctccgatgacgatgacgggcatagacggctttttcaaaatcagaaggacaacgacgataacagccggaatgagcatccatatatgaatatcaaacgttttctgcaatgaagattttaagaattcaactttatcaagatcaatattttttccgccgtatataaatcccgttacggtaaaaagaatggccgtaataatataggacggaattgacagatacatcatcgctctgacgtgtgacagcacatccaccttagaaagcgtggaggcaagcaccgtactgtcagacagcggtgaaagcttgtccccgaagtaagcgccggacaaaacggctccagctacgatcggaagcggtatgcccattccctctccgatggccatcattgcgattcccgccgttcccaccgttccccaagacgttccggtcgcaacagacataatggaacaaataaccagtgtagcaagcaggaaaacatgaggattaataaactctaaaccataataaattaaagtcggcacaaccccgccggcaatccatgttccgataagcgcaccgaccgaaacaagaatcaaaaccgcttcaagaccgttcgatatcccggtgacaatagaggactgcaagtctttatatgaatagcccagcctgactccgagaataatagcaataaaccaggatataaacagagcaagctggatcggcaggtctaaaaacaccgtaaatgataaaacaagcgctaaaaacccgaataataagatgataatttccaataaatttggcaatctgacctctttcacaagaaaatccccctagaagaaaaaagctaaaacgctttcatcaaataatataacaaattatactatactgcctcatccctttgtatggcaaccgcctattcaccaaaaaacgtgaaaaggcggctgttgttgcttaaaaatttatttttccaaaagatcttttccagcgatccccggttttgtcatttcatatggattcaaaatgatatccaattcttcttctgtcaatacatcattttgaaggcagagatcccttacagattgccccgtcatgattgcttcacgggcaattcgcgcagccgcctcatacccaaggtgcggattgaccgctgtaatgacgccgacgcttttttccacgtattgcttcaggcgtttttcgttggcttcaattcccgccagacaatgatcggtaaatgagcggaaaccgttgttcataatgctgatggattgcagcaggttaaatacgagtaccggctccattacgttaagctccagctggcccgcttctgaagcgaggcagatcgtattgtcattcccgataacctggaaggcgatttggttgataagctctgccattacagggttgactttccccggcataatggatgatcccggctgacgggcgggcagggaaatttccgcaagtcccgcgcgcgggcctgaagccattaagcgcagatcgttggcgattttagacatgttcatcatgcatactttcaacgcagctgaaacttccgtatacgcatcggtgttttgtgtggcatcaaccaaatggcctgcgccgacaagcggcagtccgctgatgtcagcaaggtgcttcacaacctgttctatgtagcgcggatcagcgttaagtcccgtacctacggccgttgctcccatgtttacttcatagagatgctggcgggattgtttaattcgttttatatcacgctcaagcacgcggctgtatgcttcaaattcctgtccgagacggatcggcacagcgtcctgaaggtgtgtgcgtcccattttaatgacggaatcaaattgtttcgctttatctttaaagacactcagcatatgcgccatcgtatcaagaagcttatcaagaagttttaaggtagaaatatgaatcgctgtcgggaacacgtcgttcgtcgattgtgacatattgacgtgtgtgttcgggctgaggtgaatgtattcaccttttttatggcccatgatttcaagcgctctgttgccgattacttcgttggcattcatgttcatggacgttccggctccgccttggatcggatcgacgatgaattggtcatgccattttccttcaagaatttcgtctgcggcctggacaatcgcgtttccgattccttcatacagccgttttacatccatattggctagcgccgccgcttttttgacgatggcgagcgcattaatcatttcttcatggatgcggtagccggtaatcggaaagttttcttttgcgcgcagcgtttggatcccgtaatacacatcagcttcaatttgtttttctccaaggaaatctttttcctgacgatattctttttgcgcgtttgtcatgctaaaaccctactttctctttgtcttggtcatatttttacagtactacgtcgtctgcgatcggtgtctccataatacttttaacttcagccaaattgtgagactggccgagtgcccacattaatttcggcacgatggcttctgtgttcatatttctggagcggataatgagatcttgattgactcttcgtccgacttcatagacgctcatgtcctctccttcttcaaggcattgggtcgtaatgacaacgacaatgccgctttcaatcatttcattgactttggcgagaatgtctctaccttcaaacggtacgccgccgctgccgtagctttcaatgacgattcctttgtacatgccttttaacgcgtcaaacatttccggtttaagtcccggatggagcttgaggagacacacgtccgtgcaaagtgaagtattcaccgtaaaggcatcgtcttccggcaagtgcacgtgtttattgtattcaattccgttttcggtaataaacgcgatatacggatagttaatgctctcaaatgcatcatagcttttcgttcttaatttaatggcgcgggtgccttgaatgactctgccgtcaaatacgacatatacgccgcccacaccttcacatgcgaagcggatcgcgtccgtgatattttttttggcatcggttttttgaaatgtaatcgggatttgcgaacccgtaatgacgatcggtttatcagcatgctgaagcatataagacaatgccgctgatgtataagccattgtgtctgtaccgtgtgtaatgacgaacccgtcgtaagcgtcatatttttctttgacagcatcagctatttggacccaatattcaggctgcatatttgtgctgtcgatgttcattaacgaatgggtttccatcgtgtaatcgttatcaagttttgatacgtaggttaacaattcatctgctttcactccgggtgcaagcccgttttctccttcgactgaggcgattgttcctccggttgttaacagcaataattttttcataccctgcacctcttcatcatttctcaagatgtgttaagcattcgcttttcgcatacttttaatcaaattatagacagacaaatgaaattaatcaagtgattattattcaattcgcgtacacttttacatatcgatatgatataatttgctcaagtgaaaaggagcggtttttaatatgaatttagatcgtttaactgaactgagaaaaaagaaaaattggtctcttcaatatacggctgaccggctcggcatcgccaagagcacgtacgccgggtatgaatcaggctaccggcgtccgtcattcgaggcgctgggaacgcttgccgatctgtttgacacgacgtgcgacgatttactggggcgcactgaaaaaaaggcggagccgtttacccagaccatcgaattaacaaaagccgcacaaggccgcggcacactgaccgttgacgggcagccgcttaatcaggatgaaatcatcgaattaattgcgtttgtccgaacgaaaaagaaggtacaggaggagctccgctgaaaaattgctttacggctttatccggccgtacgttcccccgcccccggcctcaagggcgagctgtccggtgcgcgctttatgaatgacggccgctattttaggctgtacgacacgcgccaagtcctcttcttttgcccgatgaagaatcgccatctccgtcccgaaagcccgcttcagtttttctaatgttttcggcccgactccgggaatgaactgcagcgggatttgatgaatatacggaggccgcggcacgcggcttttttccgatccgctcagttcctcgagccgttcactgaccccttttgtcattgtttttcccccgcactccggacatgcggaagctcctttttcaaccgggctgccgcagcggtcgcaagccgtccggtaatacttccctagcttcggattcagtccgtaattcgccgtgatttttcttccgtccttcccttttaaagccagcgaaaattccgtgaaattcgcttccttaagaagcatttcattatattctctgccgattttccctaaggaatgcgcatcagaatttgttaaaaatgtatacgggtcaagttctgttaaccgcgaagccatatcggtgtcgcagcttaatccgagttccgccgcatcaatgagcgccgggtcgaatacttctcttaaagaagatctgaccccttttccgtacaggcttttatgcggggtgaacatatgggcgggaataaacagcccgcccaattcctttgttttcttttggagattcaaacctgtttcataaatgcgctgtgaactgagatggatgtttgtaagcctttttgcgagccactcggaaaacatcttcatttcggcaagagccggcataaagacgagaacgtgaatcggcccgaggcatgtatgatcatagatttcaagctcacttcccaacagaagcgtggtattccgataccggatgccgccttctttcagttcacggtatctgccttcttcaattccgcgctcgatttcttcaatgacttccggggaatggcagtcgatgatgcctaaaagttcaattcccttcccctcgcttgcttcttctaatatccggtgcagcgtcaatgttttggctccagtgattttgaccggttttcccgtatgggtgcgcccgatatgaatatgcagatccgcataaatggttttcatcatttttccttcagcgcttctttcagctggagatactgaatcgcgtacgccgttttagcgtcatacacccggcgctcttcggtcagtttcacggcctcatcaagcgtgacctgcatcacttcgacaaattcgtcctcatccagctcgcgcttttcttctagcggcgaaagcccttcagcaagaaagaggtgcacgatttcatcagcaaatccgggtgatgtataaaaagcggtaattttcgtcaaggtttccgccgtatatcccgtttcttcctccagctctcttaaagcggtatgctcgggctcttcccccttttcaagcttgccggccgggatttcaacgatagtccgttccagcggctttctgaactggttcaccaaaatgatttttccttcttcggtcaccgcaagcacggccaccgcccccggatgcttgacgatttcccgcttgcttgtttttccgttcggaagctctacatcttctaagtaaaggtctatgactttcccgtcatacagcttttttttcgctagtgttttttcttctaaatgttccatcatttcatctcccgttctgtctctctattatgcctcatatattttatcatacatgcatacgagggaggtgcttttcgattgaaggtataccggaaggataacagcatcgtattggtcggaaaggcttgggaagtgcgggctaaactgaaagagtacgggcggacattccgctatgtcggagattggatcaccgggccttaacagttgaaaacttcgcgcctttatattacggtcaataaaagaccataaaaaggagcgaaacaatgagaaaacgcacgctaggacgttctgatttagaaataagcgaaattgggctcggctgcatgtcgctgggcacggataaagctaaagcgctgtctattttggatgaagcgattgagcttggaatcaattatttagacactgccgatctttatgatttcggcagaaatgaggaaattgtcggagaggccgtcaaaaaccgcaggcacgatatcattttagccacgaaagccgggaaccgctggaatgatgagaaagacggctggcattgggacgcttccaaaggatacataaaagaagcggtcaaaaacagcctgcgccggctgaaaacggactatatcgacctttatcagctgcatggcggcacgatggaggataacatcgacgaaacgatcgaagcattcgaggacttaaaacaggaaggtgtcatccggtattacggcatttcctcgattcgtccgaatgtcattaaagaatatgtgaaaaaatcaaatatcaccagcattatgatgcagtacagcctgctggaccggcgtcccgaggagtggctgcctcttttagaggagaacggaatcagcatagtcgccagaggaccggtcgctaaagggcttcttacgaaaaaaccgcttgatcaagcggccgcaagcataaaagagaacggctatttaacatattcttttgaagaactggcagaaaccaagaaagcgattaacgctgccgcccctgatctgagcatgacggagctttctcttcaatacttgctttcacagccggccgtcgcttctgtcataacgggagccagctcacttgagcagctgagagaaaactgctcggcagcagaggcccggcgtttaagcagccaggaaatcaaagccctgcaatgtcatacaaaacgggacgtatacgaagcccatcgttcttaaacaataaaaccggcaccttttcagatgccggttttatttatatttgtgccaatcgagactgctttcattcagcagctcttcaaagcttttatttttttctatttcttttcgctttctgatttgttcggcctttttctgtgcctgttttttctcgtcttcttccttcagctcacttttcatttgcaaaagcttggccttcagatcttcctccagatcgtcttttaagctgtgtttttctttaggcagctgctttttcatcattacgcccccgtatctgaatatgctgaagcaagtgtaccacggagcgccggaggccggcaactgtccttcttttgttcagctgcctgaaaacccgggaaaggattttctatatttctgtcatttaaaggagggttcctgcgtgaaaaaatggctggcggtgttcggttcggcttgtgcagtctttttagctgccggatttgctcttacgaatctgattatgtttattaagaaaaaaacggatgaagatatcatgaaaagagaaacggcggacggacatgatctatttgattcctttcagaccatggaaaaagaagaggccgtcatcttgtcacgccacgggtatgagatcaaaggcttttacattgccccgtatgatacggcaaacaccatgattatttgtcacggcgttaccatgaattcgttcaactcattgaaatacatggatttgtttttagatttaggctggaatgtgcttatgtatgaccaccgccggcacggtaaaagcggcggcagaacgacgagctacggctattttgaaaaagatgatttggaagaagccgtgaattgggtgagaaacaaaaccggagacggcggtcaaatcggcatccacggcgaatcgatgggggcggtgacggccttattatatgcgggcgggcatcagaacggcgacggcgctgatttttatattgcggactgccctttcgcaagctttcacgatcagctcgcctacagactgaagcgggaattccggctgcctccgtggccgattctgcctttggctgatttctttttgcggatgagagagggataccgtatccgtgatgtatcgcctttgtcggtgatcagccgcatccggcagcccgtgctgtttattcacagtaaggaggatgattatatacctccttcttcttccgaattgctgcaccgcagaaaacgcggcccgaagatgctgtatcttgccgaatcgggcgggcatgccatgtcgtacaccaaaaatccggaaagctaccgtaaagccgttcaaacctttttagataccatgacgcaaacgtaaaaaagcgaaagaacgtatgctcgttctttcgctttcccgtcataaaacgtcggtaatcccgtccatattttctccgatccagtcaatggcgaggtcgattgtcgtaaattcctgcgctttgaaggtcatctcatcctgaagcaaccagacatccttctgaacggattcagcgcctccaatggaccagtgcagcagactgtacgggtggttgttgttcaggaaggatacccacgtcttatgctgtgccgtctgtttaatggctttcagcttttgattcactttccgtttctccctgctttactaatatgctcattctcgggctcagcatctctgccgggctttttaagacgagcgttttcgccttttcattgtaatcgattgtcatttcctcgtcaaaaaacactttttgagaggtctggatgtaaagcggaagtccgttggtttcaatgcgttcgcattgccccgttaattcgtccgtcagccagatggtcggcacgccgctgacagcgcatccgcagccttctgcgtcatagcggagctgcgcttttttctgcgggttggcgtccatcgcctgctggaatgtatgtttcgccgcatccgtcacatgtatttgcatagatgatcctccgtttttcattttcgccaattgtagcataccgcgccgctgtatgcattgtttctgcttttttacagcagaccgctctcccagtccttcgcctcttgttcagccgccttgatccagtcatttttcccttcaatatactttcccatatcgtacgggtatgtctcggcgagctgctgtttcagctccatgtattgagccgctttttcaggtcttgcggtgaggtaatcccggaacagcagatgacgctttacgtccgcatgtcctgtttcgtatatgtggacgtggtgtgtgcgcttgttgccgcctttttgaaaaaaacgccttccctttatcccgttctccccttttgcctcatagccgagtgcttccagctgcggacggtatcggtcagcatccaaaatatctttgacctccgccagtatatcaatgaccggttttgcggccatccccgggatggaggtgcttccgatatggctgacagaatggagtgcgggtccgaagattcggatcaaaaccgccttctctctctcaaacatctctttccattccggcttgtacggaatgacttccgctttcctcttcggataaaaatgaaaaaacgagagggtcagcccttccggcgtctcaatctgtccggcttccgtgaacccggtttttaaatagagagagactgccggaacgttttgtttagcggtagccacctctattttttgagcgtcccggttctcgtctatcacaaattgaagaagcgcccgtccgattcctttccgaaagccggacgggtgcaccgtcagccggcatatgacaagttcatatccctttttttcatacgaaatgacgcctatgagctgatcttttgccttgaaaccggcaaacgtctcccgtgaccgctgtatgtcacgcggtgtctcatgcagagcgggaatgccgaaaaagccgatcaactcggcttctttttgataagagcagcgctgaaccgctgcaatttcccgcgccgtctgttcttgtgtatgctgtaaaaatgtaatcaatcttccactccttttggtgcaaaccgctatgactccgttttcgttatgcggatcgcgtacgcactttttcctttttgttttgccgtccggtggccggtatggtctttccgcggtttcatcgcatccatgaacgctttcttcgcctaaaagccccgctgtcagtatgctcagattctccctttattgatgaaaaaatgaccgcataataaggcggtttgggcgtgtcagctaaaaaacccatattcggcctcctctatatgtatttcacaaacagaatccggtcttggcccgggccgtcataattcgcaaaaacagggattccgtttacggttttggttcctttttcaggttcaaagcctaactttgtatgataagcaattgacactttattaacaggcgccgtcacgcaattgacttttgtgcagcccctttttttcaccgtctccataaatcggtcgtagagctgttttccaatttgcatttttctgaaatccgggtgcacaccggaaaaatgaatgtaggccgtctcagggtctgactgtgactgaaacccaattaaaaaaccggtcattccctccggcccgtatgtaataaagcttgtgtcctgaaaatgttcaaaaaacaagcgcggcagtttttctttcatttgcctgccgccccaccattcattcaaaacagacgtaaccatttcatagtcttcagaggtgattgttcgaatatccattttcgattgactctccttttcgtccggcaaaatgaatgtcagctcttctcattggaatataaaaaattatatgtgggttatttgcaattgtaaatgatttctttttatgcgaacgaatcagccgtctcccaatcggggaatgatttaccagtataaacgcggtcattgttcgggtacaatgaaaaacagaacaaacgttcccggaggttttttttatggctgatattcttcttgttgatatgcaatcgttttatgcgtctgtagaaaaagcggaagcgcctcatcttaaaaaccggcccgtcatcgtttcgggagatcccgaaagacgcagcggggtcgtgcttgcggcttgtccgctcgccaaacgatacggcgtaaaaaacgccgaacggctgtgggaagcgcaggccaaatgccccgacgccgttatcgtccgtccgcggatgcagcggtatattgatgtatccgtcatgattaccgaactgtttgagcggtataccgaccttgtagaaccctactccatcgatgagcagtttctcgacgtgaccggaagcaggcggctgttcggtgatccttttacaatcgccgaaagcattcaacaagcgattatgcgtgaattcggtatttatgcccgtgtcggcatcgggccgaataaagcgctcgcgaaaatggcttgcgaccattttgccaaaaaaaacgcatccggcatccacaggctggatatgtcaaatatcaggcaggatctgtggcctctgccggtcggaaaactattcggcatcggaaaacggatggagcatcatttaagacggatgggcatcagcacaatcggcgggcttgccgggcatcctgccgaactgctgaaaaaacggtggggcattaacggcgaattgcttcagcggacggcccgcggcatcgatccctctccagtcaccgtaaacacgcacagccggcaaaaagcgatcggccataacatgacgctccccagggactactgccgctttgaggatatcaaagtcgttttgctggagttaagcgaagaagtggcccgccgcgcccgtttcaaacagtacatcggccatacggtttcggtcagcatcagaggcgcagattttgattttccttcaggttttcacagacagagaaagctcgtctctccgaccaatttcggaatggatatttttaaagcggcggtcaagctcttcaaagagcattggaacggtgagcccgtccgcagcgccggcgtcgccctttcccagctggagccctgtgattatgttcagctgagcctgtttgattccctggaaaaaaagatcagcctcggcaaagtattggatgatattcatgagcggtacggccccgcgtcgctgctccatgccgcttcgctgacagaggccggccaagcctttcaccgggccgaaaaaatcggcgggcactacaaataattgaggtgatatacatgaatccgaacaaattaacccccgggtataatgtcatgtgggagtcaagccggatgatgctgcccgaacatcgggagcagctgcttgcaaaaaaacgaaaagaacgggaattccggcctccggaactgagcgaagagcaaatgaacgacatgaaccgcaccattacggcgtcgattgaagaagacagggccatttcggtcacctacgcttcagcacacggcccccgccggttttggggatgggtaaaacaagtgatgcacgacgaaaagcgtttaaaaatcataaacgatgaagatgcattatcgctgccgtttcatcttattctctcagctgaattggaataaaaagcccatcccgtcctgacagaaaatatgatagaagagtgggaggatcatatgatatttagtagaatagatgaatgataagaataggagaatatatgatggatcaatttatagaaaaaatgctgggacaggccctccgccagtatggacggaatgtgtcgacagatccgctgagcccctatgaaaaacagcgtttaaaaaaagctttagaagaaagaaggaacgaagaacccgatgaggatctccatgcccatgtagaagatattatctacgattacgtcaccaaccagggccagttctcctgacactgacgtttatgcaccgggcgataagggaaacggtcgagagtaaacccttaaagattgcgtggtgcaggagatgccagtcgggccttatttcaagatcggatatgccgttcttttgttattcctcattatttatctcggaacattaatagactttttgttccagcctgttgtgattacggctaaaaccttgtttccgcccattgtattatcgggggtcctttactatttgtgccgcccgatcgtcagagtgctgcatgagaaagtaaagctgcccgaaggcatcgcgattttagcgatttatgcgggaacagccggcctttttgtcctcttcctttatacggcgggccctgccgttcaaaaacagtttgcagccttcacagatcatatccctgagctttccgcaaaagctgaaaattggatcagacaccttcaggacagcaaatggttttcccggattcagcatgaggattcctttaaaaaagcagcggacaaagccgcaaattattcaggttcaatcgctgattctctcagcagcctggccggtgcggctgccaatgccgccatcaccgccgccatcattccgtttgcgctgtattacatgttaaaggaaggaaataaagcgccccggcggctgctgcggcttcttccggaaaaacatcagaaagaaggaaaacaaatccttcaggacatggatgaggctctcagttcatacatacaaggacagctgctcgtcagtttttgtgtcggtgttctcgttacgaccggctatttcataatcgggctcgattatccgctcgtcctgggtgcgttcgccatggtgacaaacctgattccgtttatcgggccttggatcggcacatttccgggagtcattgtcggattgttcgattcaccgacgcgagcggtgctggtggttatagtcgtcgtcattgtccagcagcttgaaagccagctgatttccccgcaaattatgggccggaagcttgacattcacccgctgaccatcatttttcttctgcttgccgccggtaaattctcgggtattgccgggatgctgctggccattcccggctatgcggttgcaaaggtgatcataagccatatgcagaaactgttcattctcagaaaaaaacaaggctagagagaaacgattcacccctcatgccttcacatcggttaaaataaaaaaaaggcgggctgaagaatcccgccccacacggaggtcaaaagatgaacatcggtgatgtcatttttcaattcgtttcatttattgcagccgcgattttcctgtttgccgtgatatacgtattcagaagcatgaagcagcgccgccagcaattggacaggatcgaaaagaaactcgatgcgctgcgcgaagaaaaaaaccgcaaataagggggtcgcgggatttgtgtcacacccgtcttaccagcacctcttcaactttatggccgtcaccttttctcaaaatcaaatctgatctgaattttgtcggcagaatattttcatacagattcggacggttgacgctctcccaaatggaggcggccatggcatccgcttctgcatcagacaaatccttaaatttatgaaaataagaagccgggtcctgaaaagcggtttctcttaaaaggcggaagcgctccaaataccacgtgaaaatccggctttcttccgcatccacataaatcgaaaaatcaaagaaatccgatacaaaaatccgcggatcttccctgtcgtcctctaaagtcggcgactgcaggacattgattccttcgataatgacgatatccgcaccttcgacaacttcgacggcgccctcttccctgtcataagtaagatgggaatataggggcgcctccactctctctttccctgattttatatcattcagaaactcaagcagcgcttttacgtcataactttccgggaatccctttctggacagaaggttcttcctttttaattccgccgtcggatacaagaaaccgtcggttgtcaccagactcaccttcggcctgtccggcagacgggaaagaagcttttgcaaaattctcgccgtcgtgcttttgccgacggcgacgctgcccgcgatcccgataataaacgggattttcgctgaatgcggatgcttcagaaacacgttgacatgctgattccgtcttgcggcagacgtgacatgaaggtggagcaggcgcacaagcggaatgtaaatcgtttctacttcttcaaccgataggtagtcgttcagcccctctacggccttggcttcttcctctgaaacggcaatggaaagatggccgccgaatccggaccacgactcgcggctgtgctgcgtgtacaatgtatgtaagttcaattctttacttttcacaattcacaccaatctctctgtatggctttccggttaaaaaacaaacgcttacaaagattgtaacggaaaaccgcttcactgtctgcccatttttttcgcaaacgaggaaccgatgcggctgtactcttccatttcctcgtccggaaccatgctcccgccggtgctccacacaagatgcacggcattttccatctcaagcccccgctcttttatataacggtttcccgcttcggtctgaacgaacttgacagctccggccataccggcgagggcagaaggctcaaggctcttattctcggacgctcttaattgataaagcagcgaaaaaagcgtgctgtcatcagcggtataacagccgctgagtataggttccataagagggccggccagtccggacggccttcccaccgcaagtccgtcggcggccgtttgattatcaagaccgatatcctgcacgctgattccgtcatgcaaaccggaaaacagccctaacagcatacacggtgagtgcgtcggctccccgaaaaaaatatggacatgttcgccatagaccagctttagcgcaagcgcgacgccgcccgggcctcctccgaccccgcacggcagatagacgaaaagcggctcatcagcatcaggctttatgttcatttgatcgagctgctttttcacacgtccccccgcaacagcatagcccaaaaacagatcccgtgaatgctcatcatcaataaaataacaataagggtcctgctgcgcctgaatacgcccctctttaacagccagactgtagtctgcttcgtattcgatgacgcggacccctttttcccggagcagctcctttttccactgctttgcgtcaccggacatatgcacggtcacacaaaagccgagcttcgcgccgattatgccgatactaaggcctaaattgcctgtagagccgacggctatagaatatttcgagaaaaaatcagtaaaccgcttctcagtcaatatgctgtaatcatcatcttttgagagcattcccgctttttgcgcgaggtcttctgcatgcttcagcacttcgtaaatcccgccgcgggctttaatggaaccggaaatcggcagttcatcgtcgcatttcaaaagcagacgcccagggaaagcccggccggcgctgtgttccagacgtttcttcatttcattgatcaagacaagcggagattcaatgagacctcccgcctctttcgtctccgggaaagctgatgcgatataaggcgcaaaccggcgcagcctttcttccgcttcagcaatctcctcattccattcagcggcatgttttatgtgatcatcgtttttgtgcgggttgatccaaaagacttcacgcgcctccgccatttgcctgacgaaaggctcttccatcaatgccgtgcgtatatcccgatcagacatttgccttctcccccttgttactttttctttaatacccggccggccagtttttctgtaaacgaagggaaaagctgatacagcttcgtcccgaggctcatccatcccggaagattaatttcccgtttatccgtcaaaatcacggacgtaatgcgctctgccacacggtcggcatcaagcatccatctgccgacgcttttaacataactgccctctttatctgcaattgtaaagaagtctgttttgatcggtccgggattaaccgttgtcacagctacacccgtaccggccagctcgagccgcagggcattggaataccctaaaacggcatgtttcgtagcggaataaaggcttgatttcggcgtcgccagtttgccggcctgtgaagcgatattgataatatggccgcttttggcatgaagcatcaccggcagacaggctttcgtacaggcgattaatccgaatacattgacttcaaacattgacttcatatcatctaaagatgaatccgccgcagtttcaaaaataccgaaccccgcgttgttaattaatacgtcaacatgaccgattaaacgccttacgttttcagcttcttctgcatgccggacgtcaaacggaatgacatcacaccgtccgccccgcgcagtaatcgtatttttcacttcctgcaagcggtcttcccgcctggcggataaaaaaacatgggccccttctgccacgcaggaatatgcaagccgttctccaagtccgcctgatgctcctgtgatccaaatccgtttatccgttaatctgcccatttcattcactcctttacagctttaaacatcaaagtgtttcccgactgaaaagatacggccttcccttcagcggccagcacgtcaagatggccgatcgtttctgacattgttaaaaacaattcgttttcatacacagccggaaacagccgccggcatacttggaaagccgtcagcgtttcctctgacaacaggtgcagcacatagtccgcccggtttctctgtttttcaagccgcctgtcagcagctggccttacgtctgtcagcagatcgccgtgccccggatataaaaaagccgggttgatgtcatacagccgtttcattgatttcaaatagtcgagcatcggggatgagcgcacactccccttttccggagcctccagaatcggattggtggagctgttggacaaaagcagatcaccgctgaacatttcaccgtttttttcatggtaaagcgcaatatgagaagcggcatgacccggaatctcaagcaccgtccagccatcaagcccgtcaatttccccgccttctcccactgttttcgttagcggacggtttgctgaaaataagtatgacagcttaactgttttatgtatgtcttcaggtgtcagaggaacgcccatttcggtcataagggacagaaaaaaatcctcctgccgggcgatatacgactgatcctgagtcatgtacctgtcattcagcggatgcccgacaacttccgtgtcatcagaaaaaatgtgcagcaaacctgagtgatccgcgtgatgatgagtgagcaccacttgttctatatccgctgcggagaccccgtgttctttaagctgcattgagagtgattcagccgcttcctttgtattcgggccgcaatcaataagggttaatgcgtcatcttttactaaataaacgataacgtcgccgactgcaaacggagtcggcacacgtatcggaatgatctttctcgctgccatatttacgctccttcgttcttttcattcctgaatactcatattttagccttttctcatccctgtgtcattattgccgcatatcagaaaaaaagattgacatcccgctctgctgcatagcataatgaacaacaaactagaaaaaacggaacgcgatgacgaggaactagtatataaacaacggcagcagagagcaatgtccccggctgaaagacattgcggccctcttgtttacagaacctgccctcagagcggttaggaaaacctaaacgtatccctcgttacgggatttgagctgagcacggctgattcgtgctaatgtaaggtggtaccgcgaaaccttttcgtcctttttgacgggaaggttttttgtgttttggaaagaaggaggatttatatgaagaaaatcggttttatcggggccggatcaatggcggaagcaatggtgaacggactgctgcagagcggactgacagcccccggacatatatacatgacaaaccggtcaaatgacagccggcttgaagaacttcaagacacgtacggcgtgaaaccatgccgggataaagaagagtttttcagcaataccgacattatcgttctcgcctttaaaccgaaagatgcggcagaaagcattgagaacattcgcgaatacgttaaagatcagcttgtgatttctgtcatcgcagggctgacgattcacaccattcagcattatttcggcagaaagcttaccatcatccgggcgatgccgaatacatccgcggccattcaacaatcggcgaccggtttttctgcaagccctgaggcgagtgaggctgaaatccggatggcaaaagaactgctggaaacaatcggagaagcgacgctttttgaggaaaaacaccttgatgccgtcacagccattgccggaagcggccccgcctatgtgtaccgatatgtcgaagcaatggaaaaggccgcccttcaagtcggcctgccggaagagacggcaaaagagctgattttacaaaccatggctggagcgacggaaatgctcagaaaaagcagcaaacgacctgagcgcctgcgcaaggaaatcacaagcccgggcggcacaacggaagcaggccttcgcgctttaaacgagcgccgctttgaagaagccatcatacactgcattacagaaaccgcagcccggagcgcagaaattaaagaacaattcgcaggctccgttctgcaaaagacggatcaatcataaagcatggggctccccatgctttttttcgtccatttacaatttcggaagaccgctaacggcttacaggtttcttttcttgcacttatgaaagaggacgagcgagcaaaagcgaaaaataagactttcctgaaaaaaagtttgaagccgggctgcacccatgaggcaaaatcacatgtaggggaagaacacattaatcaaaagcggtgcattgacggttgagcttcaggacgaaggcgtgagccggcccccggtgatgcccatcagtttaccggggcgacgccgcagttatcttaattcctcgggtcacttattttgtgccggtccattatcctcatcctgcttaaacggcatatcaggcttcttcagacagaagcctgatggatcgcaacccattcttttatgcattgaatcagtttctgaacagaaggtgtctgcgtctcctttgcacgagctgtcaaaatgccgatctgcctgcagacataccggtcgagccgtttgatgagcacatcacaatcattcaccaaaagctgcggcaagaggctgatccccagattgttccgcaccattgcaataatcgcttcatcccctctgatttgataggcgatccgcggcgtgattttttcttccttcagcactttcagcacatcaaaatgtgtctccggataaggcacgatacatttgacggactccatgacatgtaaaggaaccgtttcacattgcgccaattcatgctgcggactcatcactactacaatcgggtcctcggccaacgggtaaaaatgccacttcccgctgtgggatgtcccgatcgccgcatcaacctgatcgtctttcagccattcttccagttcagttgaattcccttcaaacaaatgcaccttaatggaaggatacagcacattaaattctctcaaaattttcggcagccattttaccgccacactcgtaacagtgccgagccggatttctcctctttctaatccattaatattatcaacggtttcagacaatttttcatagtttttttgaatttccttcataatatgtaacactttcaagccatttgcggtgggcctcactccatgccgctgtctgatcagaagcggaaaaccgtactcttcttctaatttactgatcatttggctgatgttcggctgtgtgtaattcaatatggcagcggcttgggtcaggctgccgctttcaaccgttttaataaaggctaaatgtttctttaaatccaaccggcttcatctcccagatatcatttcttattatccagcgcattagttatatttagtttacttatacatcaatcaaaaataaaatggcaatgtctccataattatacttgataacaaacagaaggtgagcgttccagcatgagttttctcattcaatttttgatcggcggcaccgttatggtggctgctgcgtttttaagcaaatcgaaatacttatttttatcaggcgttatcacattgctgccgatcatgacgttgctgaatatacaattgcagctgaaaaatatgagcgccgacgatttcagagcagctcaaaaaaacggaatattcggtgcgttcggcgcggtgattttcatcagcagtatttttatcctgacaaactggttcaaaggaagccactccgtcatcggtgcgtttcttatctatatctgctatatgatcgcctgtaaatgcctgttatgaagatacagcccccctgtataaaaaaatgcccggtcagaacaataagaacattacgctcagttgtgagcagtttatatgactgaatgatcataagttgttataatcaatttctaaaacattccgggaggcgaaataaatggccagaaaattatttacaccatggaccgttaaagatgtaacgatcaaaaaccgtattgttatggcaccgatgtgtatgtattcctcacatgagaaggacggaaaactgcagccttttcatatggcgcactacatatcgcgcgcaatcggacaggtcggcctgataatcgttgaagcgacagctgtgaatccgcagggacgcatttccgatcaggatttgggcatttggagcgacgatcatatcgaaggttttgccaaactgacggaacaagtgaaagcgcaaggttcaaaaatcggcattcagctcgcgcacgcgggacgtaaagctgagcttgacggagacatttacgctccttcagccattccgttcgacgagcagtccaaaacaccggctgaaatgacgacagaacaaattaaagaaaccattcaggaattcaaacaggcggcggcacgcgcgaaagaagccggctttgacattatcgagcttcatgcggcacacggctacttaatgcacgaatttttgtcaccgctgtccaatcaccgcacagacgaatacggaggatcacatgaaaatcgctaccgcttcttaggcgagacgattgacgccgtcaaggaagtatgggacggcccgttatttgtccgtgtttctgcatctgattatacagacaaggggctggacattgccgatcacatcggttttgcgaagtggatgaaggaacagggagtcgacctgattgattgcagctcaggcgcactcgttcaagctgatattaacgtcttccccggctaccaagtgagcttcgcagagaaaatccgcgagcaggccgaaatcgcaacaggcgccgtcggtttgataacgacgggaacaatggcggaagaaattctgcagaacaaccgcgctgaccttatttttgtcgcgagagaacttctgcgcgatccgcactttgcaaggagtgcagcgaagcagctgaatacggaaataccgtcgccggttcaatacgacagagcatggtgacagaagagacagccggagatttttcgatccggctgtctctttttttattttttgagaaacgattgccgaagcttctccgtcttccctatagaaccaattagaggggatgactccaatgaaagcagcatggatggaaaggacatacttgattgacggatgtccgttttatactaaacaccgtaaaggtgccggcgaagtgacgatcgtctttgaagccggctacggcacttcttctgaaacatggacatcattactcgctgacatagatgaagaatttggggttttcacatatgacagggccggaatcggcaaaagcggacaaagcaaaaacaagagaacggcggatcacatggtacaggaattaaacgctctactgcttaaagccggcgtcaagcctccttaccttgtcgtctcgcattcatacggcacgattatcagcagactctgggcgagccgaaaccgccgggatattctcgggatggtattgcttgacccggtttctgaggatcaggagacaaaagtgcttccgcttcttcccgaggaaatgaaagccgcctatctgaaacagttcatactagaaggatcacatgcggaatttttgacgagtcttcggcagattaagcaccagcagcttcatttcagcgatatgccgctgttgattttatcatcgggagagcgggatgagcgcttaaagcacgcgcatgaacaatgggtaaacctgcacagaaatatgcttgatatctcgcatcaaagcggatggattcaggccaaaaacagttctcacgccattcatcacgatgaaccgcacatcgtccacctggccatttatgatgtttggtgtgcggcgcgccagcaaatgaatgcgcctgcctatcaggcggtaaactgataaaacaaaagccattgtgccgcggcacaatggcttttttattcgtgatctactttgtctcacggtgcaaagtatactttttcaaccggggtgaatactttttcagttctaaccggtccggattcgtccgtttgttcttcgtcgtaatataatttctgtcccctgtctctgtgcaagccaatgtcacattcacacgcatcattttcacctcacgatcaaatcgtaacaattacgttttattatagatcatcaaacaaaaatgtcaagcgcacattttttaagagcgctccacggcaacctccataaagtcaaaggcgaccttactgttttcaaataccgctttcgcctcatgttccagccgctctatcggcgcttcgccttgatacctggcgctgatatgagttaagatcagctgtttggcgcctgctttttttgctgtttgcgcggcctgttctgtcgtcgcgtgataataattatgcgcgagctttgcatcttccttggcaaacgtcgcttcatgaacaagtacatcggcattgcgcgccagttccgttacccgctctgatacacgggtatccccggaaaaagcgacgattcttccctttttcggcggctccaaaaaatcctcaccattaattattcttccatcgtcaagcgtgactgtttcgccttttttgattttctggtagacaggtccgggcggaatattcatttctttcagtctgccggcctgcaatgcaccgggaatatccttttcctgaatccgatagccgaacgcttctacaccgtgaatgacggatgctgcggtgacgatgaattggtcatcctcaaaaaccgttccctcttcaatttcatgtatggcaagaggataagtcaaatgtgtcgccgtcactttcaggcttgtttcgataaatgcttttatgccttttggcccgtaaatcgccagctcttcttcaccgccttgaaacgaccggcttcccaataaacccggaaggccgtaaacatggtcgccgtgaagatgtgtgatgaatatcttttcaattttcctcggtttaattgttgtatgtaaaatctgatgctgagtggcttccccgcaatcaaacagccatacggagcgcctttcttcaagaagcttcagcgcgacggacgttacgtttctcgtctttgccggcatgccggcccccgtccctaaaaatattaattccacaatgcttcctcctagatctttgtactactaaggatacaggatcaggctgaaaatgtgaattcgccaggggcgcccccggcatgattaatttttttccgcaaaccgcaaaaaacaggctgaaatgtttgctttcaatgaattttagatttaaaatgaaggaaatatgcggggttttaaaccatgcttcagataaagtgaggtactctaagtgaaaacaaacgacaaaccaaaagcagtaattgtaatatttggtgccacaggggatttggcaaaacgaaaactttacccatccattcatcgtttatataaaaatggtcaaattggtgaagagtttgcagttgtaggtgttggaagaagaccttggtcaaacgaggacctccgggaaaccgttaaaacgtctgtttcttcggctgggcaaaaagacacagacgatttcacgtctcatttttattaccatccgtttgatgtaacgaatccgggttcctatcaggagctgaatgtcctgcttgaccggcttgagcatacatatgaaatcccgaacaacagaatgttttacttggcgatggcccctgaatttttcggcactatcgcaaaatcgcttaaaaacgaaggtgtcacggcgacaaaaggctggtcccgtctcgtaattgaaaaaccgttcggccacgacctgccgagtgcgaaagagcttaacaaagaaatacgcgaagcgttcacagaagatcaaatttatcggatcgaccattacttaggcaagcaaatggttcaaaacatcgaagtcatccggtttgcgaatgcactgtttgagccgctgtggaataaccgctacatctcaaacatccagattacgtcaagtgaagatctcggcgttgaggaccgtgcgagatattatgagaaatcaggcgcactccgcgatatggttcagaatcatattttacaaatggtcgctcttttggcgatggaaccgccgattaaactgaacacggaagaaatccgcagcgaaaaagtgaaggtgctgagagcgctacgccctgtcgctcaaaacgaagtgaatgattacttcgtccgcggacaataccaagccggaacgatcgacggcacccctgtagcgagttatacggatgagcataacgtagcgccggattccaatacggaaacattcgtgtccggtaagctgttaatcgataacttccgctgggccggcgttccgttttatatccgcacaggaaaacggatgaaagaaaaatcaacgaaaattgtcgttcaatttaaagacattccgatgaacctttattacggcaatgaaacgaatgtaaatccgaacctgcttgtcatccacattcagccggatgaaggcatcactttatatctgaacgctaaaaaattaggcggagccgcacacgctcagccgattaagctggattactgcagcaactgcagtgatgaaatgaacacaccggaagcctatgaaaaattaattcacgactgtctgctcggcgatgcgacgaacttcgcccattgggatgaagtagcgctttcctggaatttcgtcgatgcgatttccgaaacatgggctgccgacaaaaccctttctccgaattatgaagccggatcaatgggaccgaaggcttcggatgacctcttggaaaaagacggccttcactggtggaatatataataatcaaaaaaccgcggcgccgttcattacggcccgcggtttttacatatcagaaaagcccccgcaataattgcgggggctttttcattacttcatccattcagtatggaaaatgccttctttatccgtgcgttcatacgtatgcgcgccgaagtagtcacgctgcgcttgaattaagtttgcaggaagcactgccgtacggtagctgtcgtaatacgcaagtgcgcttgagaacgaaggtaccggcacgccttgggctaccgcaagtgaaatgacttggcgaagagcgccttggtagctttctgcgatatttttgaaatagctgtcaagaagcaagttgtcaagctccggctcacggtcatacgcatctttgatcttttgcaggaacgccgcgcggatgatacagccgccgcggaagatcatagcgatctcaccgtatttcagatcccagttatattcttctgacgcggctttcatttgggcgaagccttgtgcgtaagaacagattttactcatgaagagcgcttttctgaccgcttcaatcagctcttctttattttcagtaaccggcttaacgtcaggtcctgacagaaggccgctcgctttcacacgctcatctttcattgcggaaatgaaacgcgcaaacacagattcagtgataatcggaagcggtacgcctaggtcaagagcgctttggcttgtccatttacccgttcctttttggcctgctttatcaaggatgacatcaacaagcggtttgcctgtttcttcatcttttttggtgaaaatgtcagccgtgatttcgatcagatagctgtcaagttcccctttgttccactcagcgaatacttcgtgaagctcttcggcagacagtccgagcacctgtttcagaatgaagtaagactcagagatcagctgcatgtcaccgtattcgataccgttgtgcaccattttcacatagtgtcccgctccgtccgggccgatgtatgtcgtacaagcttctccgtccactttagcagaaatggcttctaaaatcggtttcacaagttcatgcgcttccttttggccgcccggcataatagaaggccctttcagcgctccctcttcaccgcctgatacacccgttccgataaagtgaatgccgctttcggcaagctctttgttccggcgctgtgtatctttatagtatgtatttccgccgtcaatcaaaatatcgtctttttccagatgaggaagaagagattgaatcgtcgcatccgttgcagttcccgctttaaccattaatagaattttgcggggcgtttcaagagactggacaaactcctcaatgctgtatgtaccgacaacatttttgccttttgcctcttctaaaaactcttccgttttgctgcttgatctgttgtacacagacacagaaaatccccggctttcgatgttaagagccagatttttacccattaccgcaagaccgataactccgatttgttgttttgacatattctaacgtcccttcttcaaacgtttaaccattttaaaatttaaattaaaataaaatgatatttatactaaagaaattatcatagataaccccttttttcaagttattcagcttttcttttcatcctgaaaaaagtctctgttaaagctcgttccctttgttttgctttcttcttttttcataacggcgccttttctgatcaggtttcggccgtacttttcattcagctgattcatcatctgaaaaatcggctcgtcctttgcatcctccttgaacgaaaacagatcaagctgtttatacgcctgctgtttttcaaccagttccgttccggtgatgccgagaagccttactggattttggttccaatgtttgtcaaacagctccattgccgcttccatgatgtcttttttctgatcaaccggattgctgagggtcatgcttcttgtgaccgttttccaatccgcataacggatcatgatgaacagccggcaggccatgacctccttacgctggagccgttcgcttacagaaagcgcgagacggtcaaacacgccggttaattcgtcccagtcagccgaatcatgcgacagggtggatgagttgccgacgcttttaaattcataaatccgctcgggatcgacttctgcatggtggatgccgttcgctttatccttcagtctcgggccgtttataccgagcagcgtcttcagcgcatgctcatctccttttgccagatcaccgatcgttttgatgccgagcgtttttattttttccgcagttttcgttcctataccgtgcatttcttcaatcggaagaggccacaatacgtccggcagctctctttttcttaaaatggtgatgccgagcggttttttcatgtcggacgccattttggcgagaaatttattcggagcgatgccgatgcttgacggaagcaaaagctccttttgcagtcttgcctgaatgtctatggcggtctcatacgccctgtgtctgtgcggtgtgtctgtaatatccatgtatccttcatcaatagaaacgggctcgactaaatccgtatactccctcaggatgctgaacatttcttttgacgaactccggtagcggtcaaaattcggaggcacgacgatgagttccggacagaggcgttttgcccgccacaccggcatggtggtctttacgccccgcgctctcgcttcgtagctgcaggtgacgatgattcctttccgttccttcacgtttccggcaacggcgagaggttttccctttaaagacggatcatacgccatttctacggaggcatagaaactgttcatatcgatatgaaatataattcttccttttccggccactcccggcgcctcctttcctttcatagacaaacctcatatatatgtagtaaaataaaagctgaatggatgtgatgaaatgattcttgagtcaatgaatgactttttatttttagtcgattttttcacaattattcttcccgctctgaccgcgatcggcatcgcatttcttttgcgtgagtgccgcgcaggcgagcattggagaacgaaacgtatagatgaacatcaagcagtcgttcagctgaaccgaacagactttcttattattatatatcatcgcattacaacttggatacgtaaagtcatccgcatgaattcaccggcgaatgatgatgaagatgtcagcttcctccttttataacggcaagtgataataaaaaggaggagacatgaattgtctaaaacatatcaaaaatggattgctttcggattgttttttatcgtgctgttcacaggccgctcggcgtttgcggcgacatctcagactcagacgggaggactcggaaatatcgggtttttccacgattacctgatcgaaccgttttcggccctattaaaaggtgtggcgggcctgttccacggtgagtacggactgtcgattattctggtgacgattatcgtccggatcgttgtattgcctttgtttgtgaaccaatttaagaaacagcgggtgttccaggaaaaaatggctgtgatcaaaccgcaggtcgacagcattcaggctaaaatgaaaaaaacgaaagatgcggaaaaacaaaaagaactgcaaatggaaatgatgaagctttaccgtgagcataatctgaatccgatggcaatgggatgtcttccgatgctggtacaattcccgattctgatcggtttttattacgccatccgctcaacgccggaaatcgcttcacactcattcctgtggttcagcctagggcactctgatatgcttgtatccctgtgcgcgggggccatgtatttcttacaggcttatgtttcccaaaaactaaacgagaaatattcaccggccgctcaaaacccggccgcgatgcagtcagcaaaaatcatggtctttattttccctgtcatgatgactgttttttcacttaacgttccggctgcgcttccgctttactggtttacaagcggactgtttttgacagtgcaaaacgtacttttacagcagacgcatcataaaaagaaacaagctgcggctcaagcggagcccgtaaagtcataatactgaacctgccggataagttccggcaggtttttttcatgcgtttgcagacgcgaaaaaaaaaagcacccaattcattgggtgcttcgttttcagtttgccgctgtttcgataatggcaacgaccatttccgccgttttcacgagctcttcaatcggcattttttcatttttcgtgtggatttgttcatagcctactgacaggttgactgtcggaatgccgtggccggcaatgacgttcgcgtcacttccgccgccgcttgtctgaagctcgctcggccggccgatttttgccgccgcttttttcgcgacttccacaacctgatcgccgtcctgatatttgaaacccggatacatgaccgcgatgtcaacttctgcgcgtccacccatctcagctgcagcagattcgaaagcttctttcattttctgcacttgcgcttccattttttcagggactaatgaacgcgcttcagccagaatatcgacttggtcgcagacgatattggtttgtgtgccgccttcaaaacgcccgatattagccgttgtttcttcatcaatacggccgagcggcatttttgagatcgcttttgacgcgattgtaatagcggagatgcctttttccggttctactcctgcatgagccgttttcccgaaaatggttgccctcactttcgcttgtgtcggcgcggctacaatgatgttgccgactttcccgtctgaatcaagcgcaaaaccgtatttcgcggtaatatctgaacgatccattgcttttgccccgactaatcctgattcttctccggctgtgatgatgaattcaattgttccgtgctcgatgttttgttctttgagtactctgatggcttcaaacattgcggcaaggcccgtcttatcatcagcgccgagaatcgtcgtgccgtcggtttttacataaccgtcttccacaaccggcttaacgcctttgcccgggacaaccgtgtccatgtgcgatgtgaaataaatcgtatccgcatcttttgtgccctttaaagtacagattaaattgccggctccgtgacccgtcacttcttttgtatcgtcttcttttacgctcaatcctaaatcagtgaatttttgtttgagcactttgctgatttccgcttcatgctttgtttctgaatcaatttggacgagttccagaaattcttccagcaggcgtttttcgtttaccatttacagttccctccgtttaaagcggtatattaccgtgcttttttttcggtctttcctcttccttatgcgcaagcatgtcaaatgcctgaatcaattttttcctcgagtcttccggccggatgatatcatccaccattccgcaggccgccgctttatacggaccggcattttccttttcgtatatggcttttttttcgcgcttcgttttttccggatcatcagaagcctgtatgtctctgcggtataaaatcgacgacgcgccttcagctcccatcacggcaatttccgcattcggccaggcgaatacaagatctgccccgaggcctttcgaattcatggcgacataagcgcctccgtaagcttttctgatgatgagcgtcactttcggcacggccgcttcggcaaaagcatacagcaattttgctccgtgacggatgattcccgcgtgctcctgctgaaggcccggcagaaatcccggtacatcagcgatcgttaacagcggaatatgaaacgcgtcgcaaaaacggatgaatctcgacgctttgtcagcggcatctatcgtaaggctccccgccaaatgtttcggctggtttgcgataacaccgactgtgcgccgtccgatcttcagaaaaccgacagcaatgtttttggcaaaatacggctgaatgtcaaaaaacgttccgtcatccgccagttcttttatcacctgtaacatatcgtaaggtttcgaactgtccgcgggaacgagggtatttaataacggcctggcgtcttcctttttaacgggtgatgccgtctgtctgccgtgcggaagataagaaagcagcgttttcactgcggaaagagcctctttttccgttcgtgcggaatagtgggcatttccgctgatcacattatgtattccctcaccgcctaaactttccgcgtcaatctgttcacccgtaacctgttcaatgactttcgggcctgtaataaacatgtgcgacgtattttccgccataattacaaaatccgtcagagcgggtgaataaacagcaccgccggcacacggcccaaggatgacggaaatttgcggaatcactcccgagtaaaggacgttgcgcctaaagatatgaccgtatccatttaatgataccacaccctcttgaattctcgcaccacctgagtcgttcagcccgatgatcggggttttatttttcgcggccagatccatcaccgctgcgattttctccgcatgtgtctcgccgagcgtcccgccgagtacggtaaagtcatgagcaaacaaatacacgggccgtccgtcaattgtgccgtatccggtaatgacgccgtctcccggcgcattttgacacccgggcatgcggctttttgcaaacggctgaagctctgaaaaactgtctttgtccaataaataggcaattctttctcttgccgtcagcttgccttttttatgctgtttttcatttctttccgctccgccgccgtttgttaaaaaggaacgtttttcgtttaagtgtctgatatgctcactcatgctcatcttgagtttctcctttttcaattgtttcacaaagctcaatcaggaccccgttcgcctcttttggagagagaaatgcgattttcttcccgcccgctccgttctgcggttcatgatggatcaatgtcatgcggcatgattcaagctccttgatcgtttccttaatgtcgtcgcaccggaacgccagatgatgaagcccttcacctcttttctgtaaaaaagagctgacgggagacgcgtccgacagcggctcaatcagttcaagctttgtgcctcccgcttctaaaaaagcagctttcacattttgtccgtttaccagctcttctcccatataagtaagccccagcatccgttcgtaaaatccccttgctgcatcaatagagctgacggcaataccgacatgatcaagttttttcatagcgcggccacctgctttccgccataggatatggcttgttcatacaagcaaaacacgttaaaatgataaacagtaatcttaaggagtgaaacgatgtctcaaaaattcatgaaaagcgccgtcatcgtcattctaggcgtatttatactgtcaaccgtcttttcaagcattatgatgtatttgcgataaaaaagcaggcgcctcattgcacagggatctcctgcttttttatgagggctttccgctcttttgcaatgttctcaaatgagcggttttcttttgtaatcaacacttttgttccctcagggatgatccgaaaaatatggatgacatcccggtttttcatacggatgcagccgtttgatacaaaccctccgatcagctcttctctgtttgtcccgtgaatgccgtatatcctgccgtcggttcctctcgcgtcaaaaccgatccagcggacgccgagcggattttccggcgcacctccctctacatttttcttccgataatatggatttacggctttaaccgttaccgtaaattctccttcaggcgtcagatcatctgtctttcccgtcgccacctgataaatgccttctattcgattatccttcacaacggctagcgcatttgtggctttattgacgattatataagggtcacccggcaaaggattcgcgccaagcggccaaagcggggacagcagcagggcggctgacaataaaaaaaatcgcatgggctcccctccttttttcattagaatgaccaatgaaaggaggactcatgcgatgatccatgtgttttttacagcttgatgcctttgaaataacttttaatcacgagatattgctccatctcaccgagcaggtgaaacaaagccgcccgcgcttcaaactcctcgcgtgttgccgggagcggcatctcttcaaattctgttctcatatctgcaagtctttttaaaaatttatgagcggtattgccggggtgaatggcttcccttaaatcatggatgaaatgggcaatcatttttccctgctccaccgttattgaaatagaagtaatcttcggcagcagccgttcgatgatttcaaattgtttctgtctcatcttaaaatagtgataatagagattttcatggcgcaaaatatgattctgcacgtcccggtaggcaaggtttttcgcctcttgaatcatctgatgcgtctccggtatttcctttcccgtccaatcttgctcaccagttaacaaataccgttcgatttcagcgaagatgacggcaaaattgtcctcaatttttttccggtacgccgcaagtttcctatcgaggctcggcatatacagattcattaacagcgcgacaccgatacctacggtgatcagctggaactcattccagataaacgccatcgtaatgccgccggacatatatagatgaagaatgataactgagcttgtgacgatcccttcgtttattttcaagacgactgtagttggaataaacagcacaagcaatattccgatcacaaacggataatagccgatcagtccgaaaaagacatatgaaaagacgattgccaataaacaggcggcaaatcgggcccacgaggcctgaagcgaccgcttttgcgtaatttggatgcacaatatggtgatgattcctgcggatgcgaagttttgcagatgcaacagctgagctaaataaatggccagcgccgttccaagtgcggtctttagtgtgcggtaaccgattttaaacattgcttgctccattctgtttgtttctttctcaaaaaaaagaagaagagcacgcttcttcttttcttacagttatattttataatattttttctaaaaagtcctgtgctctttttgacttcggagaaagaaaaaattcttccggctgcccgtcttccactatcgtgccttcatccataaataatacgcggtctgcgacttctttggcaaatcccatttcgtgcgtgacgatgaccatcgtcatgcccgtttgagcgagctccttcataacctcaagaacttctttgaccatttccgggtcaagagctgaggtcggctcgtcaaacagcatgatgtcaggattcatggcaagggcacgcgcgatggcgacacgctgcttctgcccgcctgacaaacggttcggatagtcgttccgtttttcaagcagtccgactttttcaaggagagcgcacgccttttcctccgccgcctttttggactctttcttcacgctgaccggcgcatatatgatattttcaagcaccgttttatgcggaaacagatgaaaatgctgaaataccatcccgatattttcccgcactttcagtttattcgttttagcagcggtgatttctttttctttaatggcaatcgttccgccgctcggggtttccagcagatttaagcagcgcagaaacgttgatttgccggagccggaaggtccgatgacagcgacgacttccccttctgcgatctgtgttgaaatgtttttcagtacttcatgttttccgaatgattttgacaggttgtcgaccttaatcattggctttcagcttcctttctacgccttttccgatgaatgctaagatcaaaacgagcacgtaatagatgaaaccggccacaatgagaggttctaaatagttgtatgttgcggcaccggactggtaggcccgtctcataatatcgccgagaccgattacggtgacgatcgccgattctttcgtcaaggtgattaattcgttaataatggccggagaaatgtttttaaatgcctgcggcagaagcagatctttcatcatttttccgtacggcacaccgagagcgacggccgcttctttttgtcctttgtcaatcgcgttgattcccgctctgataatttcagagacgtaagctgctgaattaagtgataatgcggtgaccgccgcccaaaattggtcgatctgaaagccgagaagctccggcatcccgaaataaataatcatcagctgcagcacgagcggcgtgccgcggaatatcgaagtataaaaatccgcaatccatttcagcggactgatcgtgctgattttaaacaaactgagcacgatgcctaatacaaggccgatgaccgctgaaacgagcacaattttcaatgtgacggcaaggccttccaatataaaaggaatttggggtattgtcgctgagaaatccaaattcatacgtttgatctcctttacctgtattcaagataaaaagctcaacgaaaagttgagctttcttttatttctcgttggtgaaccatttcttcttcagtttttcgatttctccgtttttctccatttctttcagcgctttgttaaacttcgctgtcagatcactgtctttgcggaacgcaatcgcggaacccgattcgtctgatttcgcatctgctgatgcaaagccctgcagatcattatttgaactgaaatagccttgtgctacgatgtcttcgataatcgcggcatcaaaacgcccggatttaatctcttccgttaagtctgaaatgcggttgcggtcttcaagctggaaaccgtatttcgaagcaagtttcttgcctttttcttcttgaatggagccgagctgaacaccgacggttttgcctttcagatcatccagggatttaatgctgcttccctttttcgtaacgatcatattgttagcagtataataaataccggagaaatccacttgctttttccgttccggcgtaggtgtcattcctgataaaatcatatcaacctgcttagacttcagggctgtgatcaggctgttgaagtccatgtcctgcacctcaacgtcatagccggtctttttgcccagagcttttgccaaatcaacgtcaaacccgacgatctgatcgccgtctttatattcaaatggtttataatcagccgatgtacccataatcaatttgttctttccgccctctgagcctgaattgcctgatccgcaggcggacagcgcaaaggtgatacatgcggcaaccaataccaacagccatttcttcatgattattttcctccatatctgcttatctcttaaaattgaatatttattcgttaatctgtattttaaacactttttaatagttatgcaatactattttcgaaaaatatatttccttatctgcgtttattatagtcgttgattcccgaatgagtgacaactgaacgccggtgcataaataatttatatttatacaaacccaatataaaaaaaccccgcaagcgctcggctccggggttttcctttcacttatacttcttcacaatattcttcaaatgcttcctgcagttttgtgacgacggccataggctcatgtccttcaatttcatggcgttccaccattttcatgattttcccgtcttttaaaatcgcaaatgacggagaggacggcggatagccttcaaagtattctctcgctttggctgtcgcttctttgtcctgtccggcaaatactgtcacaagctgatcggggcgtttatcgtaatgcacggaatggtacgccgcaggtcttgcaattccgcctgcgcatccgcacacagagttgaccatgacaagtgtcgttccttttttcgaaagcgcttcgtccacttcctcagcggttttcagctccgtatacccggcggccgtgatttcctggcgggcttgacgcacgacatcattcataaataaattaaaatccatattcaactgggacctctcctttttgatcatctattcttatgatagcaaggaacctgccctatcggcaaatgacaccgctcatatccgaatgttttttgtcccttttatgttcctctatttaagtttatgaccttttaaaaacgggaaacttgttaaggagattgtctgaaataaaggagcagtcgtatgagccaacggaaagcagtattaatttataacggtaacgccggtcagaaacagattgataaaacgctcggcacggtcgtccccattttggcccagtcagctgatgagcttttgattaaaccgaccaaacatcaggatgatgcccgtcggttttgtgaaaatctcgacagctcggttgaccatttatatattttagggggagacggtacggtgcatcaatgcatcaacagcatcagcaagcttgatcacagacccgctgtcggcattttgccgggaggaacgtgcaatgatttctcacgggcgctcggcattccgcaaaaccttcaaaaggccgctgaagcgctcgcggctgggcataaacggatgattgacgtctgtaaatcggatgacggctattttctgaacttctggggcatcgggctgatcactgaagcctccagccatatcaatgaaacagaaaaagcatggctcggaaaaatcagctacttcacgagcgccttgcggacgatgacaagcgcgaacccttttcccgtcaaattgacgatcgacggcgaggtgaaagaagatgaagccgttatggtgcttgtcatgaacgggcattacatcgggacaaacagagttcccctgcctgatgcaaaccttcaggacggcttagccgatgtgttaatctgccgcaacacaagccttggagcattgcgggagctgatgacaatggaacagggtacatttgatgatttcaaaggggagctgtcctatattcaagcctccagaattgaaatcgaaaccggacgcgagatggacgccgatacggatggcgaggtatacggaaagacaccttgcacgatcgaagtgaaaaaacatcatctcactatgcttgttcccgaagattcagaatgaaactgaaaaaactccctttgccacccgggcaaaaggagttttttttaatagactgaagtattttcgtcaatgttttctaagatctctttgacgcgtccgaggaaacggccgcacacaagcccgtcgagcactctgtgatccaaagacaggcaaagattaaccatgtcacgcacggcaatcatcccgttattcatgacaaccggacgtttgacaattgattctacctgaagaatcgccgcctgcggatggttgataatgcccatagactgaaccgagccgaaagatcccgtgttattgacggtaaatgtgccgccctgcatatcatcggcggtaagttttccgtctctcacttttttcgcaaggtctgttatttctctggctatgcctttaatcgttttttcatcagcatgcttaataaccggaacaaaaagcgaatcttctgtggcaacggcaatggagatattaatgtctttcttttggacgattttgtctcccgcccacatgctgttcatctgcgggaattctttgagagcctgcgccgccgctttcacaaagaaagcaaaaaatgttaaattgaagccttctttctgtttaaacgagtcttttatgctgtttctgtatgccgtcatgtttgtgacgtcgacttccatcatcgtccaggcatgcggaatttctgttttgcttttatgcatattggctgcgatggcttttctgacgcctgtaaccggaatttcaatatcaccggctgacagagctggcgccggtgcttgtttttgctgctgtttcggctcttgcggggcttgaacggcagccgctttcggcgtttccgtcttctgctgcatgcccgaatcaatgatcttttgaatgtctttccgtgtaattcttccgcctgcacccgttccttcaacttgttcaagctgaatgccgtgttctcccgctaatctgagcacggccggcgaataacgcgctttatttgaccggtctttgcccgctccgtgtgaagggttatttgcaggtgtgctttgctcttcttcccgcttcggcgcttcttgggtttccgttttttctgtttcaattttgcagattatctcgccgaccgcaagagtctgcccttcttctcctacaagttctgtaatcgtgcccgtaaaagaagacggcacctccgcattcactttatctgtcatgacctcggcgatggggtcgtatttattcacatgatcaccgggggataccagccatttgctgatcgtcccttctgttacactctctccgagctgcggcatcgccatttgttcaatcgccatgtcaaaaacctccttacgtctttaaaactccgctaattctctcattgcggcttctgctttgtcaggattcatcatgaagtatttttccatcgtcggcgcataaggcatcgccggaacatcaggacctgcaagccgcttgatcggcgcgtctaaatcaaataagcagttctcagaaataatggcggcgacttcgctcataatgctgccttctttcgtatcttctgtgatcagcaaaacttttcccgttttagacgcggcttcaatgatggcttctttatctaacggatagaccgtacgcaagtctaatacgtgcgcggaaattccgtctttttcaagacgctcggcagcctgcagagcgaaatgaacgcataatccgtacgtaatgacagtaatgtcgctgccttcgcgttttacatcggccttaccgatcggaaggacataatcatcggcagggacttcgcctttaatcaggcggtatgcccgcttatgctcgaaaaacagcacggggtcatcatcacgaactgcagcttttaacagcccttttgcgtcataaggagttgaaggcatgacaattttaagtcccggctggttggcaaaaatggcctcaacagattgggagtgatacaatgcgccatgcacgccgcctccgtatggcgctctgatgaccatcggacagctccaatcattgtttgaacggtagcggatttttgccgcttctgaaatgatttgattgaccgcaggaagaatgaaatcggcaaattgcatctccgcgatcggacgcatgccgtacatcgcggcgccgataccgacaccggcaatcgctgattccgcaagcggcgtatccataacccgctcttctccgaactgctcataaagacctgccgtggctttaaacacgccgccttttctcccgacgtcttccccgagaacaaaaacgcgcggatctctttccatttcttctttcattgctgcattaatactgtcaatataagacattacagacataagtattcctccctacttcgcataaacgtgatcaagcgttgattcaggagatgcgtatggcgctttctccgcttcgtctgtcgcttcgtttacgatggccatgatgtcatccagcatggccttttcttcttcttcgccgagaagcccggcttcttgcaggtatgctttgtatatgagaagcggatcttgtttctttgcttcttctacttctttacgttctctgtagctgctgtcgtcgtcatcactggaatgcggcgtcaaacggtaggaaaccgtttctattaatgtagggccttcgcctttagacgcccgttcgcgcgcttctttcacagcctgataaacttccagcaggtcgtttccgtcaacagtgactcccggcatgccgtagcctaccgcccggtcggaaatattctcgcaggccacctgtctgtcatacgggacagagatggcatacttattgttttcacacatgaaaatgaccggcagtttatgcacggcggcaaagtttgccccttcgtgaaaatctccctggttggaagatccttctccaaaggtaacgaaagagacgatatcctttttatccatgcgtcccgcaagcgcgattccgaccgcgtgaggcacctgcgtcgtcacaggggatgagcccgttacgattctgtttttcttttgcccgaagtggcccggcatctgcctcccgcctgaattcgggtcagccgctttcgcaaaaccggacatcatcaaatcctttgcagtcataccgaatgcaagcactacccccatatctctgtagtacggaagcacatagtcggtatcacggtttaaagcataagccgcgcctacttgagccgcttcctgcccttgacatgaaataacgaacggaattttgcccgagcggtttaacagccacattctttcgtcgatttttctggctaacagcatggttctgtacatttcaacggcttccgcgtcagaaagccctaatgcttgatggcggtttgtagtcattcaaacccctccttctttccttttaaaaatgaatcgcgtttccgtctgcggctaacgcagcttctccaatcgcctctgaaagcgacggatgcgggtgtatggactgaccgatttcccacggcgtcgcatcgagcaccttggcaagccccgcttcagaaatcatatcggtgacgtgcggaccgatcatatgaacaccgagaatatcatctgtattccggtcggcgacgattttgacaaagccgtcgctttctccgtatacaagagcctttccgatcgccatgaacggaaacttcccgatcttaagttcatggccttttccggcggcttcttcttctgtcataccgacactcgccgcttccggatttgaataaatgcatttcggcacaagggcggcatcaagcggagccggattaagacccgccatatgctcaaccgcaatgataccttcacgggaggccacatgtgcaagctgcagcccgccgacgacatcaccgatcgcataaatatgcgattccttcgtctgtccggattcgtttacgaggatagaaccgttttccaaagcaatgtccgtattttcgagcccgattccttcaatattcggctggcggccgatggaaacaagcatttgttccgcgtgatacgtttcgctttctccattcttttcagcttcaattgaaacgccgtccgctttttccaatgtatccggaagcactttcgcacccgttacgatcttaattccttttttcgttaacagtttttccatttcgcttgaaatatcacggtcttcagtcggcaaaatgcggtccgcgtattcaattacagtgatattgacgccgaaatcattcagcatggatgcccattcaataccgatgacaccgccgccgacgattatcatggattgaggcagacgttcaagctgcagcgcttcatctgacgtcagaatataagtaccgtctgcttctaaacctggaagcattttcggccttgaaccggttgcgataattaattgtttcggtatcagcatgtcgttttcttcaccatttgcgtattcgacggaaatggtacccggaagaggtgagaagatggaagggccgagcatacgtccgtacccgttgaatacatcaatcttcccctttttcatcagatgggcgacacctccggccagccggtcaacgattccctgctttcgtttttgcacgctgtcaaaacggagagagacaccttccgtttcaatgccgaatgctgccgcttcctttgcggtccgatacacttctgcgcttcttaacagcgctttactcggaatacatcctttatgaaggcatgttcccccgagttgttctttttctacaacggccgtttttaagccaagctgggccgctctgatggcggcaacataaccgcccgtgccgccgcccagaatgaccacatcatactcagtcgccatttgttttcactccttcgccgatctgatattgtttcgcctgctcctcaccggctaaaacccgaagcgcgccttgcgcaagtgattgcagttcattttctcccggatacaccagtacatccgaaatccaatctatgtacgatctgatggcggaaacgaaatctttcccgtacgccaatccgcctgtcaggacgataatgtctacttttccttttaaaacggcgctagccgccccgatttctttcgctatctgataagccatggcgtcataaatgagccgcgcattttcatctccgtcctgaatgcgtttttccactttcaccgcgtccgttgttcccaggtagccggagagtccgcccgtgccgacaagttttttcatcatatcggcttttgaatacttgccggaaaaacacatctccaccagatcacccgccggaacggttcccgcacgttccggactgaatggcccttctccgtgaagcccattgttgacatcagtcacccgtccgcagtcatgaacgccgactgtgatgccgccgcccatatgagtgacgatcatcttcatctgttcataccgcttgccgagagacgccgccgccgtacgggcaacggctttttggtttaaagcgtggaaaatgcttttccgcttgatttcaggcattccagatactttagcaaggggtgtcatctcatccaccacgacaggatcgacgatatacgccgggatattaagtccgtcagctatttccctggcaataatcccgcccagattcgaagcatgctggccattgtacccgtttttcaaatcagtgatcatggcgtcattcacttcatatgtgccgccctcaatcggtctgagcaggccgcctctggcacaaacggcatcaaactttgaaatgttgatgccctgttcgtgcagagactcaagtatgcttatttttcgaaattcgtattggtcgataatgctgttaaatgttttcagctcttcttcggggtgccgcagcgtcttttcaaagatacagcgttcattgtgaaagacaccgattttcgttgatgttgagcctggattcagaatgagaatgcgtttttcctgttcgaacattttcatacctccagatcaaattcctatcgtctgcttaatacactttggccgttttgcagaaactggcttcttgaacggcgcatgcgctcaattcgctcttcagccagacggtcagccgctaagtaagtcggaatgccgtcacgcgcagaaatatcgagcacccgttcaatatttgcatagatgccttcaacctttttcaaagcccgctcagcattatagccgtaaagctcatcagctacattgatgacaccgccggcattgatgacataatccggcgcgtacacgattcccatttcatgaatggtatcaccatgacgtgtttctttcagctggttattggccgcccccgcaataactttcgccttcagctgtttaatcgtgtcatcgttaatgacggcaccgagggcacacggagcataaatatcgcacgcctgtgagtaaatgtcgtccggatcaacggcacgggccccgaagtcttcaacggcacgtttaacagattctttattgatatccgtcacgattaaagaagcaccttcttcgtgaagatggcggcaaagattgtaagccacatttcccacaccttgcacggcaattgtttttccttccagcgaatcagtgccaaacgccgctttagcagcagctttcatccctttgtagacaccgtatgccgtaaccggagatgggtttcctgatgaaccgaatgccggagaaatccctgttacatagtctgtttcatcatgaataatatccatatcttcaacggttgtgccgacgtcttccgccgtaatgtatcttccgtttaagccttgaatgtaccggccgaatgcgcggaacatttcttcattcttatctttgcgcgggtccccgataataacggttttcccgccgcctaagtttaaaccggcagccgcatttttataagtcatgccttttgcaagtcttaatgcatcttcaattgccgcttcttcactgtcatatgtccacattctcgttccgccgagtgcagggccgagcgttgtatcatgaatcgcgatgatcgcttttaagcctgactgttcatcttggcagaataccaattgttcgtaatcataagtttccatatatttaaaaatttccataggtacgttcctcctactgttcttgtgatgcgcaaatcgcaagcgcaattgaatacagtttattttctgcggtatccgctctgctcgttaatgcaatcggcgccttcgcacccgcgatgacggcagcaacatttgctttcgcaaaataaatcattgacttataaagcatatttccagcctctattgaaggaaccaagagaatatccgcctggcccgctacgcttccggaaatccctttttgcagtgctgcagcttgagatacggcattatccaaagcaagcggtccgtccgcgatacagcctgtaatctggcctctattgcacatttggacgatcgcagccgcgttcagcgtcgcctccattttcggattaaccgtttcaatagccgcaaggactgcggctttcggcatagggttccctactgaatgcgcgacatgaaccgcattttgcagaatatgccggagctcttcaagagacggggcgatgttcagcgctgaatcagtcacatacatcagccggtcatagtccggcacctcaaaaacggctacatgtgataacacacttttagaacgcagcccttcctggcggtttaaaaccgacttcagaagagttgagctcggcagattccctttcattaaaatatccgcctcttgttcgcgtactgcgcgcactgcttttgccgcagattcttcgggtgaatcggcgtggataatgtcagcattgaacttcggctcatttgccagaagctctttcagcttttcgctgtcacccgtcagtaaaaatcgtgccgacaagtgctctgccgccattttgacagcctggattacttctttatctgctgcgtgggccactgcaatggtttttgcgttttttgccgcggctttttcaactaagtctctcagcttcattttgtaccaccttccttgttcgaatccgcttttatcaatgcaagttccgtgccaaatgttcgggagggttattccggccttttttcaagaaaacatgcagctgtttgcgctttctctgcaatttattgcatgccgtcatttgcaaggccgtacttgtccattttgtagtacagattccgaatgctgacgccaagcgcttttgccgttttggttcggttgaatttatgcttttcaagcgttttttgaatgacgtgcgcttcaaatttttcaacggcctgagagagtttttctccttccacatccggaaaatcacttcgggcgccgcttttttcactcagctctgtttcaaaaacaggcagatgctgctgttctatccgctccatgtgcggctctaaaaatatcatcgcccggccgagaacattttcgagctctcggacgtttcccggccagctgtaggctgataaagcacgcagcgcgttcggcgcgagcccctttacgttgcggccgtaatcctgattgattttttcgatgagccgaatgctcagcgcttcaatatcctctttgcgctgccgaagcggcgggattgagatcggatagcggttaatccggtaatacaggtcttcccggaacgttccttccgccatggccttttcgatattgacgtttgtcgctgcgataattctgacattgacagaaatcgctttagcaccgccgactctggtaatttctttttcctgcagaaccctgagcagcttcgcctgggtgctttgggtcagctctccgatttcatctaagaaaatgctgccgttattcgcttcttcaaaaagcccttttttgcccccgcgcctcgcgcccgtaaacgcgccttcctcatagccgaaaagctcggattccagcagggattcagacagggccgcacaattaacccgaatgaacttattgtattttctgtcgctttcgttatggatggcgtgggcgaaaagttcttttccggtgccggattctccccgcagcagaatcgtcgccggcgttttcgccccgagcttcgcctgttcaagggcgaccagcatttgttcactcgtgccgataatgtcgtcaaacgtgtatttcgcttcaagcgtgcggatgatctgccgcgcccggttcaattcagcagtcagtgttttaatttctgacacatcgtgaatgactccgacgctgccttttaaaatgccgtccacaataaccggcgcaacattcacgatgacatcctttttattggggccgactttcattcttacgccccgtacaggccgccttgtccccaatactttcaggtgcatgctttctccttctgagatatcggtggaggcgggttttccgatgacttcgctttctgacagcccggtcatttttgtatacgctttgttgattaacattccgatgccgttttcatcaacgacggaaatggcttcgtctgacgattgaataatcgcttcaagcatggtgcggatttgttttaagttcgttacctcttctgccagctcaactgcgtccgtgatgtctttaaacacgcataacgcaccgagaagctttccgccttcatcaatgatcggcagtcttgtcgtgacaatctgcaggtgctttccgagaagctgcttctggttatattccggctctctcgtctccagaatccgcggcagttttgtgttcggcacgacatctttaatttggcggccgatgacatgctcccgtttttggccgaccattttttcagccatctgattaaataaaatgatcgtttcgttgacgtctataaaaatcatgccatcgtgggttgaattaaaaatccggtcatgcttatacgtctgtgacttcagcatttgaataagctgctgcttttcctccatcagctgaaacaccatgtacgccaatttccccggcatgacgatggtttgttcttttttctcatggagcagttcatccatgaccgctttgtcacctgttgtatggatgataatatctatatcttcggttatgtaaggtttccaatctgatgaggttgcaattccatatctccgggcttcttgcagcccttgcgcctccggatcttggtcaaccaccgcaataatccggatcaattttgttttcatcaaaatctgtaagagcgccgtgcctcctttaccagcacctataatcagcaccttctgcatcccgatacccctttgtatgaaaaaatttgcacacctgtattttccgttgcaataatttgcacaacccctatgttaccatgttttcatctcttgacaaaatattttttcgattggacaataaaggaaatcatatcgaaaaggggttttctgaatatgagccggcttgttgcgcttttgatcctggtcctccccggcgctgttgcggcgctcggcattaagctgatgagagatgcattattcgggcatacgtttgccccgtttccgtccctttttcttcagggagcggccggactggcgttttttttgttcggtctttatattctggccggatttattctgtaccgagatcggaaacgcaatcaagtcagcccgcggttcaggaaaaaaaagctgtaaaaaaaagcccttgcaaaaaagggcttttttcagtcatccggcagtatcgtttttgcaatggattgatcaagttcctcatagtcatggtaagcgatcgtttcatataattcttttctcgtctgcatatccgaaagcccctctttttgcgagccttcttcttttataaggcggaaaatacgctcaaaagccttggccgccgtcctgagagacgtgacagggtaaatgaccatctgacagcccatgccggagaattcttcagcgctgtaatacggcgtttttccgaattcagtcatatttgcgagaatcggcacactgatttgtttggaaaacgctctgaattcactttctgattggagcgcttccgggaaaatggcgtcagcacccgcttttatataagcggccgctcgttttaatgcgccctccagcccttcctgctgtctggcgtctgtcctcgcaacaacgagaagagtcggcgctgcctgcttgaccgcttggattttctgcgccatttcttcgatcggcacgagctgcttcccattcagatgcccgcattttttcggcaggcgctggtcctccatttggacggcggctgcgcgcgcttcatacatttctttcgccgtccgggcggcattcagcactcctccgaaacccgtatcaatatccacaaggacaggcaggtcagatgcacggaccaggtctttaacacgttcagccatttccgccgacgtgatgatgcctaaatcgggaagccctctgctcgccgtgtaagccgcgcctgacaaataaagagccgaaaaccccgttttcttggcgataagagcagccatcgcatcgtgagcgccggggatctgcaatagctccggcgctgtcatctgcgtacggaaccgctctgcaagctcctcttgagacgactgcctgctgacgatccacgtcatgtttgtcaccctcctactttatacgagaaataagtccataaattcaataacgctgagctgctgcatccgtccgctatgtttgcaggcttcttctattttatgctgctgcttcagtgaaaaatgagtgctgacgtttgctgaaaacttggcaagaatattcggaacggcttcttttctgcggaatcggtgcccgagcgggtattcacattcaatccgttccgtagctgtgccgtctgtaaaatgcacctgcacggcatttgagatggatcgcttatgcgggtctaagtaatcttttgagtacgctttatgttccgtcacctccattttgctccgcaatgtatcaattctcgggtcagaggccgtttcctcttcataatggtctgccgtaatatctccgaaaagcagcccgattgccgtaatgtactgcaggcaatgatcccggtcagccggattgtgaagcgggccttttttatcaataatccggatggctgactcatgcgtcaaaatcgtgattctgtcgatttccccgatgcggtctttcacctcaggatggagttggaccgcgcattccgcagctgtttgggcgtggaattcagccggataggatactttaaacaaaacattctccataacataggaaccaagcgggcgggcaagcttcatttcctgctgattaaataatacatcttgaaatccccatcccggtgcggtcagcgccgtcgggtatcccatttcacctttcagcgccatgagggccaaatacacgcctctgctcgtcgcatcaccggccgcccatgatttgcgcgatccggtgttcggcgcatgccggtacgttctgaggcttgaattgtcaatccaggcgtgtgatacggcgttgctgatttcctcttttgaaccgcccagcatttgcgtgcaaacagccgcagtcgccactttcacaaacagcacatggtccagtccgactctgtttaaactgttttccaaagcgagaataccttggatttcgtgcgctttgatcattgcgcgaagcacatcgcgcacggtaaacggttctttcccttcagacacccttactctggaaatatagtccgcacaggccaaaatgcctccgagattgtcagacggatgaccccattccgccgcaagccacgtatcattataatcgagccatctgttgatacatccgatattaaaagcggccgtgacggggtctaaaacaaaaggcgtgccggggactctgcttccgttcggcacggaggttcccggaacaatcgggccgagcagctttgtacattcgggatagctgagcgccagaattccgcagcctatcgtatcaagaagcacatgtcctgccgtagtgaaagcttctgaactgtcaatctcttgatggagcacataatcagaaatctcttcgatcacggcgtccattcggcgggtttctgtcatattttcatcttcctttctcatctgtttacagacgcgctccggtatagcggacacgcgggcggaaaagccggtttcggctgtgctgttcaatgacgtgcgcgcataggccgaccgtccgtgcgctgaagaatataggcgtgtacagcggaatcggaatgccgagcatgtaatagaccggcgctgcgtagtaatctaaattcgggtaaaggccttttttctcccgcatgacggtttcaccggcttcacacatgttataaagacggaaatcacccgaaagatcagacagctttttcaatgcttctttcatcatgagcgccctcgggtccatttttttcatgtagacgcggtgaccgaagcccatgattttttctttgtttgcgagtttttgagttaacaattgtataaacccgtctgtatctttcgcttcttcaagcatgtacataaccgcttcgttcgctccaccgtgaaggtttcccttcaatgaggcgacggctccggtcagagcgccgtatatatccgattgtgtcgaagcaatgacgcgggccgtaaacgttgagttcggcaattcatgctcactgtataaaagaagcgaccggtcgaatatttcttcttccaaggatgacggggtttttccggtaatcatatataaaaagtttgcgctgtacgataaggtcccgacaggcgctaaaggctccagcccgtttatgacacgatagctgttgacggtaagattcggcattttgcctatcagcccgcggacacggtgctgattcacagatgaggtgcggtcatcaatgtccttgtcaaagcctccaagcgcggacaaacccgtcctcagtccgtccatcgggtgagtatgttctggcagcagacggcagatgtgcaagatttcctcaggaaggtatccgccgcgccggacgtcctcttcaagcgccgccttctctttcgcatcaggaagtctgtcttccaataagaggtggacaatgtccatatagccggccgttttagaaagctcaatcagatcgtggcctttgatcaaaatactgccctgctgtgtatccagaaaagaaattcccgtttccaccgcaataacgccatctaaaccgggagaataagattccatgatttcgctccttttcgcacattttattgaagaagatacttagaaataatcagcctttgaatctcattggtgccttcatagatttgcgtgaccttcgcatcccgaaataaacgctccgcaggatactctttcatatagccgtagccgccgtgaatctgcacagcctcaaccgccgctttcatcgccgcatcagacgcgaactgctttgccattgatgcttcttttccgcacggaagcccgcgctgatacagatcagcagcatgatagaccaataacttggcagcttccgcattcgtcgccatgtcagaaagtttaaaagaaacagcctgattcgaggcgatgggcctgccgaactggctgcgggttttggagtactcgacagagcagccgagcgccgcttcgataatcccgagcgcctgagccgctatgccgatccgcccgacatcaaggtttttcatggcgattgaaaaaccctcgccctcttcgccgagcctgttctcaattggaatttccgcttggtcaaattgcaattcgacagtgctggaacctaacagtccgagctttttttctttttttccgatagaaaagccgggtgtgtttttttcaacgataaaagcggatatccccttcctccctttagccgggtcggttaaggcaaatgtcagatacagatctgccgctccgccgtttgtaataaagatttttgaaccgttcagaatataggaaccgccttttctcacggccgttgttttcaggcctcccgcatcagatccggattgaggctcagtaagtgcaaacgcccctacatattcgcccgctgccagctttggaatgtacatttgtttttgggcttctgtcccgaaatgcaaaatcgggtttgtccctaccgatgtgtggacggataaaataacgccgacagccgcgcttacttttgatatttcatgaatcgctaaaatataagatgttatatcagcgcccgctccgccataagcttccgggacgggaatccccattaaccccgcttcccccatttttttaatcagccggtccggaaattcatcggttgtttccatgatctcaaccatcggcgcgacttccttgcgcgcaaaatcacgcaccatttttctcatcatgatgtgctcttctataaaatgcacggctgccgcctccccctcatgatttttatgtcatctgttgtactcataaaaaccgcgcccgctttttttgccgagccagccggcgctgacatattttctgagcagagggcatggacgatatttcgaatctccgagtcccgaatagagaacctccataatggaaaggcacgtatccaatccgatgaaatcggctaatgttaaaggccccatcggatgacgcatgccgagcttcatcacatcgtcaatcgcttcctttgaggccgcaccttcgtaaaggcaataaacggcctcgttaatcatcggcattaatatgcgattagatataaagcctggaaagtcattgacttcaacaggtatttttttcatctgaacggcaagcttctttactgtttccgatgtttcttccgacgtggcaagccccctgatgacttcgacaagctccatgacgggaaccggattcataaaatgcatgccgattactttttcaggccttttggtgacagcggcaagctccgtaatgggaagagaagacgtattgcttgccaatacggtatgagggggacacagtttatcgagtgtgccgagcaattcggcctttgcttttttgttttcggcaatcgcttctattacaaaatcagcatttcccgcgtccgttaattctgccggggaaatgcggctgaaaacggcatctgtttcatgctgtgtctttcgtcctttcgcctgatctttctccagatttgttttgatgcggcgaaggccttttgtcaccatttccggctcccagtcgtataacatgacggtaaacccagcttcggcagctgtctgtgcgatgccggctcccatctgtccggcacctgcgaccatgattgttttcatcttcatctgacgctcccttcgttatatcagtacacctccagcaggacggcgtctccttgagccgctccgctgcatattgccgctatgcctaaacctccgccgcgccgctttaattcgtatatcaaactcatgatgattctggctccgcttgcgccgatcggatggccgaacgcaattgcccccccgttaacattcactttctcccggctgaacccggctattttttcgctcacgaggacgacggacgcaaatgcttcattcacttcaaacaaatcgatgtcgtcaacggacaaaccggtttttttcaagagccggctgatggcttctcccggcgcgcttgcaagctcggacgcttccagtccgacagacgcaaaaccaagtatcgcagcgagcggtctgacatgctgcttcgcggctttttcctccgacatcagcacaaatgctccggcgccgtcatttacaccgggagcgtttccggcggtgaccgttccgtcggctgtaaaaataggtttgagctttgcgagctggtcaaggcttgtatccggacgcagcccctcatctgctgcaacagtatgctgtttgccctttttgccggtccaggtgacggggacgatttcttcatgcaatttacccgtctcagctgcctcagccgcgcgtttctggcttaaaagagcgtaatgatcctgttcatctcgggaaatgccgtactttttggccgcagagcttccgtggacagccatatgcacctgatcaaacgcacaggtcagcccgtcatgaaccattaaatcctgaaaaaccccgtctcccatcctcacaccccagcggccggccggaatggcgtacggaatgttgctcatgctttccataccgcctgcaatcagcacgtccgcatctttcgcccggatgatttgatcacagatggtaacggctctgagccccgatgcacagaccttattaatggtttcagccggaacggaccatggaagcccggcatgcctcgcagcctgccgcgccggaatctgccccgcgcccgcctggacgaccattcccatcaccgcaccttctgcttcactttcactgatgccggcgcgcttgattgcttcttttatggcaatgccgccaagctcggctgcttttacctcttttaatgccccgccgaattttccgaacggcgttctagccgcactgacgataaccgtttttcccacacttttgcctcactttcaataagataaaagataacgcttacacaaaacgccctgttccaatatatgaaccggctgaccaagttatgatcgccccgtgctgtttctgcccataaaaaaagaggactgtctgaacagtcctctagttgcagcattcttcttttattgaaagagccagctttggataatcggtaaaaaatgcgtctgctcccgcttttatcagctgcttcatatcttccggccgattgacggtgaacggacggagcgccgcttggtgttttgcaagatgtttgatcacttcagcgctgaccgccggcgtgccgagcttcggatgataaccagaagctggaattgaagcaagataccgttcaggccggtaaagcacatccatcgtcagcaccgcccgttctatctcaggtgccagggcgtggcaaagcgcgaggctctcatgattaaatgaagaaaaaataacgcgctgttccagtccgtaatacctgacttttttgatcacttcttcttccattccctcgtaacggaacacgctgtttttcagctcaatattgatcagaaaatcagcacgctccgcaaaacgcagcacgtctgacaaaagcggaattctgactcctttaaacgaatctttccatttgccggcggcatctgcggttctgattttctcatacgccgtatctttcacaaatcctttcaaagacgtcgtacggtcaagggtttcgtcgtgaataaccacgattcggccgtcttttgtcatttgtacgtcaagttcgattccgtcagctccggcctcaatcgctttcgtgaacgcgagcatcgtattttcgggatagtcgcccgacgccccccggtgggcaaaaatagtcgtcatatgtgtcacctcaggtgtttgtcatcggttttctctattataatcgttatgcacataaggagggcgctatttacatatattttataattattgcccgctgtaataggtttcgattccgtttacaacagcgtctgcggcatgctcttgtccactctcgtttttcagcttgtccgcatcttgagaatttgtgataaagcctaattcagccagcacactcggcatttttgaatatgtaatgacataaaaaggggcttcttttacacctctgtccctcatctctaaagacgagacaagctgctgttgaatgtcagaagcaagcctctcactgtctgctccttcatatgttgaattaaaatacgtctctgtgcccgatgccgttgatacggctgaattcgtatggaggctgacgaataaatcggattggctggcgcttgctttcgccacccgctcgtccaaacttaaaaaagtatcatccgttcttgaagcaacaggttttgcgccttctgcctccaatttggcgatcaccttgtttgacaccgctaaattgatatttttctccagcagtccatttccgccggccccgctgtcttctccgccatgcccggcatcgatataaatggtttttccttgcacagattcagctgcataagcggacggtgcaagaagaagcagagcggcaccgaatgctgcagcgctttttgtcagtaaacccacgtgttttcctccccgttctttacatatctgtttctcttttcagtttttcaagccgtaattgtccgttgctctcttttttataggtgatttgcaccgccgtatgttcaggcagagactgacattcaaaccgcttagaaaaaggcaccttcacctcttgccgctctccgtcaattttcaccgcgatcgtatcgtttccggacgcttttatgaatgttccttcctgtgtaaatgacggcgccgaatccgcctctgcggtatactcgcagcctgataacagccatgcggtgaagatcagaagtatgacagatatgacagacttcacacagatcacctcacgttttctcattcggctttatctttgaacagaatgggcgatttgtaaagggcgccttcgttcctccagtgcttttccatatttggaatgaaggatttctgacccgctgattacctgaacttagaaagaaaacgagctgatccgtctatgaaaaaggttctgtctgaagagcggatatgcagaatttaacggaaacggacgactttctattcattttgataaaatatcaggtcatcaaaaaaagagagcctcatcatgcgctctcccgaatagaattgttcatatttattttgagtttttcataaaatgaacgggacaacttaaaagagcagcgtattgacggcaatgatgagaataatcactccgctcagcaccgtgctgaactgtccgacatggaaagatccgatgcgcaatgacgaagctttttttccaagcaagcagccgagccatatggtcagaaaacttccgaacgccgcagtgatggaaattgcggcgggagaaagcccgatcagacctgcgcttaatccgttagtcagcgcatttgcggatacggccactccgaggaccatggattccaatataccgatttctcccgaaccgtcagcatctgctgtctccgggttttgtaacagaccggcaaaacggcctttttttcttgatgacacatcagcacgcgctgaattttctttttttctcggcacagccagcaggatgatgcggatgccgatgacagataagataaaagccgccagcaagacgggaaaaaaaccaggcagaacggctgaaatccatttgccgaaataaatcccgatataactgaataaaaaacagataaaagcgatcatcatatttgacgcgtgcgatattttgatctttctgatgccgtatgacatccccactcctaaattatcaatgctcgaggacactgccaaacctaaaatcaataaccaagccatgttattttctccccattctttgatgtcttttcaacatgttgcgctgttgaatctacactatcctattcagcagtacagaaaaggtaccttttctgcaaaaaattattgactgattatcatcattccggcggaaacgaggtgacacccttggcagaaaatgaaaataatacattgggcccccttttaaaatcactgcttgataagcactcgctctccatgagaaaactcggcgccttaaccaacattgatacggccaccatctcccggattataaacggcaagcagaaggccaatttaaagcatcttcaggaattttcaaaacacctccgcaccccgctggaggaattgcttgaggcgtcaggcatagacatcggccatgataaagaagctgcgccgcaagatccgatgcacgcgattcaggatatgctgaatatggcggagatgtttgatcagcctttttcccgggagcaaattgaacgcgagctgaccagatatgaacaatatgccaaaacccagcagggccatcgcctgatttgtgatgagtttcaaaagaaaatggataacgaagaaagcgtcggcccttttattgatcacttgaaaaacatgcatcatcaatatatggatgaatcaacaccggctgaagaccgcgcgattctcgggagcgcgctgctgtattatattttggcgacggacgtcattccggattacatgtttccgatcggctatctggacgacgcgatcgccgttcaaatcgctttgcatcggctgaaaaaaaagtaaaggcgcttaaaaaagcgcccttttttgttgaaaaatatgaaacaccgcattacggttttgtcaaaacagagacagctgtcatatgatacattaacctaacaaaaaggagggtgtcttctatggacagcaacacagttgtggcagtgtgcgctctgttaagtgttgtgattcagatcggaacgatattcgccgcaggaaagtggaaaaaagaataaaaaacaaattgacggttttttcgcacaagcgtatgcttataaataatcttgtaaatgattagaaagaagttatgcatatgaaaaaaatcattctcctcttcgccgccgctgtcatattcagctcgatcggccatcaaatttcaggcggatataaagatcccgaaaaagaacggagaaaaccgttccattcatttaaatggttcagccgatcataatctcaggataaagcacaggcaaaataattgcacacaattaaaacataagctagaatacggacgagttaaactcctaaggaagaaggcgaaatgatgaaacaaatttataaaccgctgtttgaaccttttacgtttgaaagcggcgttaccataccaaaccgtatttctgtcgcaccgatgacacactattcatcaaacgatgacggaacaatttcagaccgtgaattaagctacattactccccgttcaaaagaaatgggcatggtcattacggcatgtgcaaacgtaacacctgatggcaaagcgtttcccggccagcccggtatctatgatgattctcacattcccggcttgaaaaaactcgctcaggcgatccagtctcaaggagcgaaagccgttgtgcagattcaccatggcggattggaatgccctcctgaactcgtgccaaacaaagacgtcgtcagcccgagcggctcagaagaagacggcagacaaacttcccgggctcttactgaacaagaagttgagcacatcgtaaaagcattcggcgaagcgacacgcagagcgattgaagccggctttgacggtgttgaaattcacggggcaaacgggtacctgattcaacaattttattctccgaaaaccaatcagcgcacagaccgctggggcggaagcgatgaaaaacgccttgcgttcccgcttgcagtcgttgacgctgtcaaacaggcgattgctgcacacgctgaaaatccatttgttctcggctaccgcctgtcaccggaagagccggaaacacctgggattacaatgaaagaaaccttcctgctcgccgacgcgcttgcggaacaaaacttggattacctgcatatttcactgatggacgtcaattccaaagcccgccgcggcgcagatacttcacgtacacggatggatttattaaacgaacgcgttggccataaagtgccgctgatggcggtcggttctatctataccgcggatgaagcgctagccgtattagaaagcgggattccgctggtggctctgggacgtgtcattctgatcaaccccgaatggtcggtgctgatcaaagaaggccgcgagcaggaaatcgaaaaagcaataaaagcatctgaaattgagaaataccgactccctgaaccgttatgggaaatgatccagaatacaggcggctgggtgccgtttgaaaaataaccacaaaaaactgccggatgtccggcagtttttttggttcataaatttttaccgctttgtttactcctatttctgacacactgcgtacatatagtaaatagattaatagaaaggagaccgtatatgatggctggatttcctattacgattaacagtctttccggaaacggggttgtcaatgtcggcggcgcgttttcgataagtcctttaaccgtatcaaaaacagtctacggctcaggaggaggaaatatcggtatggttctgcaaatgaatcaatccagcacggctcaatcttcaagttctcaattctctgatcaaaatgtaatgaaaacactatgatatctgtatttccctcctattccggctcacagcagccggatttttttaccgttttgtttaatcttatttcagatcacagcgtacatatagttagtagacttagagagaaaggagaaaaaatagaatgagcggttgcccgattacgataaacaacgtatcaggaaacggagttgtcaatgttggcggcgctatatccatcagtccggtgactgcatcaaaaaccgttttcggtgccggaggaggaaatatcggtattgtcattcaaagcaatgctgtgagccaggccaaaatgtttgagcatcaattttcagatcagaatattgtgaagtcaatttaagggctgccacgcagcccttatagacacgtaaagcgtcaatataagcaggccgacagaatcactgaaaacaatcagcggtcaccttctcatgttttgaatgatttcagttaagagtgaatagaatgcagattgaaagcatgaaaacacgacagtactgaatctcattacggaaagaaggaatcgcgatgaaaaaactttgccgggaagtttggattgaagttgaccttgatgcgataaaaaagaatatacgggcgatccgccgccatattccgaataagtctaagattatggccgtcgtaaaagcaaacgcgtatggccacgggtctgtcgaagtagcgcggcaggcactggaaagcggagcgagcgagctcgcagtcgccagcgttgaagaggggattgtgttacgaagagcggggattacggcaccgatccttgtactcggctttaccgctctcagctgtgtgaaaaagtctgccgtctggaatataacattgtcagcgtttcaagtcagctggatcaaaaaagcgaatcagatattggaagaagaagcggtttcgaaacggctgtccattcatattaatgtggataccgggatgggccggcttggtgtacgcacagaaaaagacctgttagcagttgtaaaagcgctcaagtcgagtacatacctgtcatgggacgggatctttacccatttttcaacagcggatgaacctgatactgaattgacgatgctgcagcacgaaaaatttatcagctttctccgttttttaaaagatcaaggcattacgctccctaccgtgcatatgtgcaacacagcagccgctatcgctttcccggaattcagcgccgatatgatccgtttaggcatcggtttatatggattatacccgtccgcctatatcaaggagctggatcttgtaaaactcacgcccgcactcagtttaaaggcgcgtatcgcttatgtgaaagccatggtgacagagccccggaccgtcagttatggtgctacatatatcgccgaaccgggtgaaatcatcgcaacaattccgatcggctatgctgacggttactcgcgcgccctttccaaccgcgggtttattctttatcgcggcagacgggtgccggtggcggggagagtgacgatggatatgattatggtcagtttgggtgagagtgagggcaaacaaggagaagaagtcgtcatctacggtaaacaaaaaggagccgagatttcagttgatgagattgccgaaatgctaggtacgattaattatgaagtcgtatctacgttaagccgtcgcgtcccccgcttttatatcagagacggcgagatcatcaaagtatcagctcccgtattatacgtgtaggtctcataaaccccgcttttatgcagcatcaagattcctcggaccagagggattttgcttatgtataaaaattcagatgccggtgcgagtgattcacttttttcaccggcaaaagcacaaaacgccttctcttccgcattgattcacggaaaagaagacgaaaaaagacatcctgccattcagcttgcgttatgaagcattatgctccaatctcagcttgtcagcaaccatcgcgatgaattctgaattggttggttttgcttttgtcatgctcacagtatacccgaacagcgaagaaatggagtcaatatttcccctgctccatgcaacttcaatggcagggcggatggcccgttctacacggcttgcggtcgtgttgaattttttggcgatgtcgggataaaggacttttgtgatgctgccgagaagttcaatatcgttatacaccatggaaatggcttcacgcaaataaagatagcctttgatatgggcaggcacaccgatctcatggataatgcttgtaatgctggcatcgagatttttccgcttcggctcaggctgactgcggataatgctgctttgcgcggacggcgcacggtgtgtgacgctgctgacattgccgcttacctggcggatatggccgacaaggttttccatatcaaacggcttcaggatgaagtaggacgcacctaaatcgacggcttttttcgtaacgtcttcctgaccgaatgccgtcagcatgatgacgttcggctgcttcgcaagttctgattcccggaggcgctccaaaaccgcaagaccgtccagatgcggcataataatgtctaaaacgagcacatcgggatttttatctttaaacaaagaaaggcattcctgtccgttataagcaacgccgagcacttccatatcatcctgtccctctatatattcactcaacaggcttacaagctctcgattatcatcagcaacacaaactttaattttctccacgtttcttcctcccccaatgtattaacaggacgcaacccatttgactgctacatgttacattcgacaaaaccactacttccccttttaaaaaatccatttttaccaataatagtggtatatctttgtttttctagcattttctaggtttttcgactaaaaattaagtttgacaaatcaggaaacgtgaatttgtcgaaaaatcttcatgtcttattttacatgaatccaggaaagaagtgaagaacgcatcaaataaaaaaactgccggatcatccggcagtcagcttgctttatcttttccgtaaacatcaacgcccgcttcagaaagcatccattcgatatgaaccccgtagccgcttgtcggatcattgacaaacacgtgggtaacagctccgacgactttcccgttctggatgatcgggcttccgctcattccctgaacgattccgccggtttttttcagcagtttcggatcggttacctttaataccataccctttgtcgccgggaatttttgcggcgtggtgctgacgatttcaatatcaaatttctctactttatcgttttcaataaccgtcagcatttgcgccggtcctttttttacttcatttgacaaagcaatcggaagcgctttgtcggaaatattgttttgaatcggctgatgcagtttcccaaagatgccgaacggactgttgcggttaatatcgccgatcgttttccgttctgacgaaaaccttgccagtttttcgccgggattgccgccttttcctttttcaatggaggttacagttgaatggacgatttctccgtcttctacaacaatcggttttttcgtatccatatcagaaatgacgtggcccaatgcgccgtatttttttgttttcggttcaaaaaatgtcatcgtgccgatgccggctgccgaatcgcggatataaaggccgattcgatattttccttcagcttcatcctttgtcggaatcagctttgtcttgattttttgcttatcgcgtttcaccaataaatccaatgattctccggttgtgcccgctttttgaataaacggggcgatatcgctcattttttcaattttatgtccgttcattttaataatgatgtcgccagattcaattcccgcttgttctcccggagacttttttccatcctttgtcatcacctgatgaaagccgacgaccaaaacaccgactgaatgcagttttacaccgatggactgtccgcccggaatcacctttaattcaggaagcacacgcactttcgtttttttaatgggaaatccggcaagatcatatactacttctgaccggccttgtttttgccctgttatgtttgcatgaccatgctcttctttcagcgtaaaggcttctgataattcgcccttttcagcgcttattgatgcattgaccggaacggcttgtgtctgtttttcaaagacgctcatttgcgacggtatcagtaaatattctttaaacggcttaaaaaagcctacacttagtaaagaaacaaggagaattacacctattgctttcctcatgttatcgtgcattcattccttcactctcctcgctcctatcccacaccactttctttttctgctacatctatacttttgccttcctgcgcttgatttataaccggcatacgaagaaaaacattggatacactgttagagaaatggaacaaaaaaataagctgcctgtatcagcagcttatcctgtcgtttttacctgtccggcctgttttaaaagctcttttgcatgccgttttgtcagatctgtcacttcgacgcccgcaatcatgcggccgatttccgctaccttgtcctgctgggaaagcggcgtgacatgcgtcgtcgtccggccgtcttttaattctttcgcgatcaaaaggtgcgtgtccgccatggcggcaacctgcgggagatgtgtaatgcagagcacctgtgaaccggtagatactttatggattttttccgcgatggcctgcgcaacccgcccgcttacaccggtgtccacttcgtcaaagatgatggaagtgacatcctgctgagaagaaaaaatactctttatcgccagcatcacccttgaaagttcgccgccggacgcaacctttgacagcggcttgagaggctcaccggtatttgttgaaattaaaaatttcacaaggtcaatgcccttttgggtaagctgcacgggctggccgttgacaactggcgcttcatcggctgacggatcggttttcacaagaaattccgtatcaaacgtagatttgcccatatacagactttttaattcctgatgaatcgcttcagccagttttttggcccatgcttttctgatttttgataagttggcggcttctacggccacatctttgcccacggactccagttccttcttcagcgtttcaaggtggctgtcacggttctcgatttgatcaatttcctcttctatctttgagccgtattccagaatatcttctaccgtcgctccgtatttgcgcttcagctgtttaatctcgtttaaacgggtttcaataaaattcagccgttccggatcatattccagatcatctaacaaattgcgcatctgaaaggttgcatcttccagcagataataggaacttgacacagtttcggacagcttttgcagcggttcattgatatccgaaatgtcttcaagctgggcagaagccattccgacccagtcgagacccccctgctcactgcggagcgcattataggcgttttgcaatgattcataaattttctcaaagttggatatttgcttccgttcttcctgaagaagctcgtcttcattcaattcaagcttagccgattcgatttcttcaagctgaaattggatcagatctaaccgatgcgccatttcctgctcgctctctgacagcttcttcacttttttgagcagcttcatataacggtcatagccttcacggtaagcctgaagcgctgattcggcctcagcgcccgcaaatttatctaaaagctctaaatgcttgtcgtcctccattaacagctggttatcatgctgtccgtgaatatctaataaaagtctgccgatctcccttaaagccgcgatcgttactaattttccgttgacacggcagacgctttttcctccggcattgatgtcccttctcatgacaatcatgtcgtcagatgcgtctattccctgctcacggcacacctcaaaaacgggatggccgctgtctaaaagaaacagtccttcaagctcggcctttgtttcaccgtaacggacaaattcagacgacccgcggccgccgactaacagggaaacggcgtctataataattgacttgccggctcctgtttctcccgtcaggacggtgagcccccgttcaaacgagatcgtcagttcctctataatggcaaagttttttattgatagttcagctaacaaacagcattccaccttttatctgataattacgctacagcagctccaaaagacggctttgaacgccttccgtatcttcaggcgtcctgcagatgatcaaaattgtgtcatctccgcaaatcgtgcccatgatttcctcccattcgagattatccatcaaagcaccgattgcctgagcattccccggcatcgtctttaatacgatcatatggcttgctgagtcaatttttacgaacgcatccattaatgaacgcttcagttttgacagcgggttgaaccgctgatccgccggcaggctgtatttgtaggagccgttattcgtaggcacctttacgagatgcagctctttaatgtctctggaaacagtcgcctgggttaccttatacccttcttctctcagcatgtcaactaagtcatcctgcgtttcaatctcctggcttgtaataagctctctgatttttatatgcctttggccttttgtcatgtaagcacctctgttttcaagctgttcttgtcattatgttaaccgcttcttgataaaaagtacatgatggcagaaaaaaggaataatagccccctattattccggtacatctgtctttttggcttttaatgtctcatgtgcttcgcggacggtacggagaatgtcttcttccggcagttcagtgccgtttccgtcttctccctcccagttcagatgaagcagaaactcaatattgccgtctccccctgtaatcggtgagaaggacagtcctttcactgcatatccttcagaggcggcaaattgattcatacggcggagaacgtcagcatgaacgccgggatctctgacaatgcctttttttccgactgattcccgtccggcttcaaattgcggcttcaccagagcgatacaatcgcttcccggtacaagcagcgtttttaaaaccggcagaatgaggcggagtgagatgaaagacacatcgatcgtcgcaaattccggcaaaccctctgtgaaatcagaaggctcggaatagcggaaattcgtccgttccattacgacgaccctctcgtcctgcctcagcttccaagcaagctgattatagccgacatctactgcgtatgaccgctcggcgccgttttggagggcgcaatctgtaaatcctcctgtcgacgagccgatgtcaatcatcgttttgcctgttactgagacagggaacacctcaagagctttttcaagctttaatccgcccctgctgacgtatttaagagggtttccttttaccgttaacggaagatcccgggcgattttttcacccggcttgtccaatcggttttcatttgagtacacgatccccgccataatggcgcgtttcgctttttcccgcgtctccgcaagtcctttttctacaagaagtacatctaatcgttctttttttgctgtcatgatccaattcctttatgtgtcttcggcggcatcagcagtttaatccggttcataacctcagccttcgtgagaccgatttcttcaagcagggcggttacgcttccgtgctcaataaaccggtcagggatgcccattctgtcaatcggcgtatgatacatgccgaggtcatgagcgaattcaagaatcgtgcttccgaatccgccttcaagcacggcttcttcaatcgttaaaatcggaagaccttcattaagaatcgccttcatcatttgtttatcaatcggttttatgaaccgcgcattgacgacacgcacggacaggccttctttttgcagttcttcagctgcttcaagcgccatctcaatcgttgttccgaatgttaaaataaccgcgtcttttccgggacggagcacttcccatgttccgatcggaatgcttttcagctctttatccatctttacgccgagtccgtttccgcgcgggaagcgcatcgcaatcggaccttcttcatagctaagggctgtattgaccatatggcggccttcattttcatctttcggcatcatcaaaacgaggtttggtatatgacgcaaaaaggcaatatcaaagacgccttgatgcgtctccccgtcagcaccgaccaaaccggcccggtcaatgccgataaatacattcgcgttttgacggcagatgtcatggacgacctgatcgtaggcccgctgcaaaaaggtcgaataaatcgcaagaaacggcttcatgccctgaagcgccattcccgcggccattgtcgccgcatgctgttctgcgattccgacgtcaaacatgcgctcaggaaattctttcgcaaacccttccagcttagagccgacaggcatggccggtgtaatcgcgacaattctgtcatcctcacgcgccagctcctgcacggtgccgctgacaagcccgctccatgaaggcgccgcggctttcggtttgacgaaatcgcccgtattgattttgtacggacccgtcccgtgccatgtgccgatcgtgtcggtttcagccggtttatagcctttgccctttttcgtgatgacatgtaaaaggacaggacctttcgtttttttggcgtattgcaggttttcaatcagttcgtgataggaatgaccgtcaaccgggcctaaatacgtaaagcccagctcttcaaaaaacatgcctgacacaagcatatattttaagctgtcttttatccgttccgctgtggcggccaattttccgccgacggccgggatgcgcttaaataaatattcaagctcgtcttttacccattggtatttgccggccgtgcgaagcctgcccagcatagaatgaatcgccccgacattcggcgcaatgctcatctcattatcattcaggatgacgatcatgtcttttttctcatcgccgatatggttcagcgcttcaagcgccattcctccggttaaagccccgtctccgataatcgggatgatatattctttcgtccctttaatatcacgggcggcagccattcccatcgcccctgagagcgatgttgagctgtggcctgtttcccatacgtcgtgttcgctttcgctgcgtttcgggaaaccgcaaagccctttatattggcgcaaggtttcaaactccttgccgcgtccggttaacagtttgtgaacataggactgatgtccgacatcccataaaaatttatccttcggactgtcaaattctttgtgaagcgcaattgtcagctcgacaaccccgaggttcggcccgatatggccccctgaggcagacagcgatgtaatgagaaaattgcggatctcctcactcagctcttccagctgttcaattgacatctttttaagaaatgacgggtcctgtattgataaaagatccaaagcggatcaactcactttcagcatgaatttctgcaaattaaacagtgtctttttgaaaaaagaaaaagactctccttgtattttcatcgaaactgcttacattttaccataggagcggcagccccttcaaatcgggatcgttttaatgatctctcgccgcaattaagtcgcagagatcatgcagcaattctttctcaagagaaaggccgcttacgatctgtttcgcctcgctgatatgatgcgcaagcttctctttcgcgccttcgagcgttaaaagcgacggatacgttgacttttcattcgtcgtgtctgaaccgaccggtttgccgatcttctcctcatgaccttcgatatcaaggatgtcgtctctgatttgaaacccgatgccgatatggctgctgaacaagcgcagcttctcgatttcatcctccggcgcatctgccaaaatggcgcccgccgtcacggaaaaaccgaggagcttggccgttttccgctcatgaatggattccagctctttcagcgttacctgcttttgctccgcttccatgtcggcagcctgtcctccgaccatcccttccgttcctgccgcgctgatcagttcatcgacgagacggagccgtttctcagctgaaacctcctcagacacgtgagatgtgatcaatttaaagctttctgtcagaagcccgtcgccggcaagtacggctgccgcttctccgaagactttatgatttgtcggcttcccccggcgcaaatcatcatcgtccatgcaaggaagatcatcatggattaaggaatacgtatgaatcatttcgacagcgcatccgaccggaatcccgtctttttcatcttttccgtaagcattcaaaacggccaaaacaacgagagggcgcagccttttcccgcccgcttccaaagaatacagcatggattttttgagggattcgggcatgtccagccgttctgtatacaaagaaagctgctgttcaatcatttgtttgcgtgatgctaaaaatgcgtccagtttatttgtcaccttcgtcttcctcctgaacgctgaaaggtgcaagttctccgttatcttttagaataaagtccatttgtttttcgacatgctgaagcttttcatggcacatttttgaaagggccatcccttcctgaaaatagttaatcgcctgctccagcggcacgtcgccttcttcaagctttgccacaatgccttcaaggcctttcatcgcctcttcaaatgtcagctcttcactttttttggtttctttcattatcgttcgcctctcttttgcaatacttcacacgtcagaacgccgtctgtcatctttacttcaagcgtgtcattttgttctacttgatcaacgcttttgatcagctctttgtctttataggccagactgtatcctctctccataacttgaaggggacttaatgcattcagtttaccaagaaccgtctgaaactgcgaatgaagctgcttcagctggacattcatgctccgctccagctgatttgagcgctcttcgtaccgtttttttgcctgtttcagctggttttctgggtgaagggccgttaatctgtacgtattccgctccagctgcctttgcttccggtccgtaagccctgtaagctgtgattggaactgctgatacaaaagatcaaactgctgttctttttgagtatacaatcgtttcggaaaacggaatgcgtaggatgactggagcgcttgcacccgttcttttttcttgctgatatgctgctgcatcgctcttgtcagacggacttccgccgtttttgtccgttccattaagtccgtcgtgtggggaacggcgatttctgccgctcccgtcggtgttgcagcccggatatctgcgacaaaatcactgattgtaaaatctgtttcgtgtccgacggccgaaataaccggaatggcggaagcaaagatcgcccgggctacgatttcttcgttaaatgcccacaattcttctatcgagccccctccccttccgacgatcaggacgtcgcacatcttttgtgcattggcttcttcaatgcgctttacaatcgatctgctggcattctcgccctgaacgagcgcgggaaggacaatgactttcaccaaggggtatcttcttttgagtgtggtaatgacatctctgacggccgctcccgtcggtgacgtgacaaccccgatcgtggctggaaaagcggggatggcctgcttatgccggtcatcaaacaacccttcgccggcaagttttttctttaattcttcatatgctaaataaagcgcacccacaccgtccggctgcatttcttttgcgtatagctgatagcttccgctcggttcatagacggaaatgccgcctcttacgatgaccttcattccgtcctcgggcttaaacgcaagccttgaactttgtctttgaaacatgacggcctgcatgcgggcatgttcgtcttttaatgtaaaatagatgtggcctctcgtatggattttaacgttggacagctcacccttaatccaaatgtcttcaagatgagggtccacatcaaattttcgtttaatatatttggtcagtgcggaaaccgtgacatatgccgcttcactcacatcctgcactcctttcataaaggctttttgccctaaactaagaaaacccgctctggctgaaaggagccttaagaagcgggtatcgtgctcattgtcacactttttgtgactgtctccggttatctatgataacgtacgtctggcagatttaacagtattatgcgcaagcattgtgatggtcatcggacctactccgcccggcaccggcgtaatgaaagatgctttttctttcgcttcatcaaactgaacgtctccgcagagttttccgctttcaagacggttgacgccgacatcgatgacaatggcgccctctttaatttgatcggctttgataaagttcgctttaccgaccgcaaccacaagaatatctgcttttttcgtatgctcagacatattttttgtacgggaatggcaatatgtgacggtcgcattttcgttcagcagcagctggccgaccggtttaccgacaatattgcttcgtccgactacaacaacttctttgccggaaagatctacgttcgtctttttcaataactcgacaattccgtgcggcgtgcatggaagaaatgtatcttcgccaagcagcattttcccgacgttgagagggtggaaaccgtcaacatccttatcaggggagatccgctcgattacggctttttcagaaatatgatccggcagcggcagctggacgagaatgccgtggaattccggattttgattgtactgatcaatcacttttaaaagctccgcctcggttaagcttgagtcaaaacggtcaagcttaaacttcattcccattgtttctgcggcttttttcttgcctgtcacataggaaacagaagcgggatcgtcgccgattaaaatgaccgccaagcccggcactacgccttgtgctttcagctcttctacttcttttgccaattgttcgcgtttttctttagccgtttcttttccgtcgatgattgttgcagtcattttctttcctcctacgattcgatatcagttttaatgttagaaagaaccccgtttacgaattttgcagctttatcgtcgccgaaccgttttgccagctcgattgcttcgtttaatgacacgttagcaggaatgtcgtcagtataaaccatttcatacaccgccagacgcaggatcgcgcggtctacgtttgcaatccggtcaagcttccaattgacaagatggccggaaatcatttcatcaagctgtacctgatgttcgatcactccgtacaccagctgttcaaagaaggcatctgttttctcaccatcaagcgcgtgctcaatggcctcgttcggtgcaatatcgctgacatcaatctgaaaaagtgcctgcaaagctttttctctagctgttcttcttttcattttctttctccttcagatccgctttatccgcttgtcgttaagcttaaagagatcataacatatttttttcccaatcgcatgtcgaaatttaggttttttcaccctaatgccgaatatttttacaaacccttttgatttcattcggatttcacagcatgaagaaactcggctgccgtttgtaagccggctttcttcatgcctgaaatgaagggaaacgtataaaaaaccaaagggctgcccatccccttggtttttatacgctcattacatttcttcgtcgatttcgacttcttgggccttcgtgtcaaattgaatgccgacgatatgaatattgatttcattaatggtcagagacgtcatgtttaataaagtttggcggatattctcctgaacgcttgctgccactttcgggatcgaaaccccgaattgaacgacgcaatagacgtcgatagtaatcccgtcatcggctaaatcgacctttacgcctttgccgtgattgattttgccgaaacgttctacgacgcccgtggcgaaattgccgcgcatttcagcaattccttcaacctcggaagcggcgatgccggcaatgacttcaatgacctcaggagcaatttcaaccttgcctaaatgagactcatcatgatccattttaagcacactgttgtcttccattcaattcacctcccgcaaaaattatgagcccattacatcatatgtttctaaaaactttgtattaaactctccgctgacaaatgtttcgtgttcaagcagtttcagatggaacggaatcgttgtttcaataccttcgatcacgaattcgctcagcgcgcgtttcatccgtgcgaccgcctcatcacgtgttgttccgtatgtgatgactttggcaatcatactgtcatagtacggcgggatcgaatagcccggatatgcggctgaatccacacgcacgccgagtccgcccggcggcaggtacatgttaattttaccaggtgaaggcatgaagtttttcgcaggattttcagcgttgatacggcattcaatcgcccagccgttaaattctacgtcttcctgtctgagcgagagctcctgtccggatgccactttgatctgttctttgatcagatcggttcccgtcaccatttcagtgacagggtgctccacttgaatacgcgtgttcatctccatgaagtagtagcgctgctctctgtagtcataaatgaactctacagtgcccgctcccgtgtaaccgacggccttcgctgcttttaccgctgcttcgcccatctgctccctgatttcagaatcaagcgcaggtgacggcgactcttcaagaagtttttgcagacgtctttggatagaacagtcacgctctccaagatggatcgtgtttccgtaattatccgcaagcacctgaatttcaacatggcggaaatcttctatgtacttctcgatgtacacacccggatttccgaatgccgtagcggcttcctgctgggtgatttcaatgcctttaatcatttcttcttctgtgcgcgcgacccggatgccttttccgcctccgcccgcagtggcttttataatgacaggatacccaatttcacgtgcaagtgaaaccgcttcttccgtattttttataattccttttgaaccgggcacaatcggcacgcccgccagttgcatcgtctcacgggcgatatcttttgtccccatttttgaaatggcgtctgccgtagggccgacaaacgtcacgtttacttcctcgcacagctcggcaaagtcggcgttttcagctaaaaatccgtatcccggatgaatcgcatccgtgccggtcagctttgcgacgctgacgatattcgttacgtttaaatagctttcttttgatgttttcggcccgatacaaaaagcctcatcggccatttggacatgcagggcgtctttatctgcctcagaataaacggctacagtttcaatgccaagctccttgcaggcccggatgattctgacggcaatttctcctcggttggcgatcaatagctttttaatcataatagcaggtctccttactcagcttttacaagaaatagaggttgtccgtattcgaccagctggccgttttcaactaacacttcaacgatttctccttttacttccgcttcaatctcgttaaagagtttcattgcttccacgatacaaaccactgtattttcgctcacttttgatccttgatttacgtaagggccggcttcaggcgatgaagaagcataaaacgttccgaccatcggagacgtaattttgtgaaggttttcgtcttgtttcggcgcttcctgaacaggagcggcttcacccgcttccggttttgcagcctgcggagcaggtgcgaaagcagcaggaacagcttgagcttgtcccgttacattcacggccggcgcttcattttttttcagcttcaggcttacgccttcaatttcgtaaacaaattcatcaatggatgattcatcgattctttttatcagttcatgaatttcgttgatttttaacatcagttccactcctatgtatgaaaaatagaaatttatgggttgctactaaaagtacatactatgtttatcttacaggagcggttgtgtaaattcaacactgatctaaaatgacatcagaaaagcccgcagcgggtgcgggcttttcaggcctattattttgtcggttcaaacgtcacggcgacgtctttcatattcttaatttctttttgcaccaggtcaatgatggcggaagcttttgcgtttgaatgtttgtcagacatgaccgtaatgttgattttgtctccttcagcatccacgagcgcatctttgtagccttgtgttttaatgagtgtttccagctgtttttctgtcccttcagcattactgagcgccgtcattttatcgtaggcttcgcttttttcctttgctgtcgcatcatcgcttgaaacaatgctgtttaactgttcccgttctttgcttctcgcgtcttcaagttccatgcggtatgtggtaaataaattttcgtcagctgtttctgtggcgaccgatccgtctttgtcggacgcttctgctgatgtttctttatcctcttttgcgcctttagaatctttagtgtctttcgtgccttttgttccgtcttctttttctgtgccgccttcggtcttttctttcgtttcaggagcaggagccggcgttttttctgtggcgatttctccgctatttttttcgcttttcatctgcacggcatttttgctttccggcgacgtaatataataaacacttaataccacgacgagactgagcattgttaaaagccaaaccgtttgttttttcagcataatttatgaatcctccttgatttttttaggggcaaccgctacacggtagctcggaacatcaagcacccttgtgacggcatcaatgatggttttttttatttgaacgttgtccactccctgagcgacaacgagtacaccgcggatatcaggctttttcgtctgaacgacgaccggggtttcctggtccccgtttcggatcatgacaatttgttcttcagaggtttgatcggttacgcttcttttgccgccttctttatcggtttcttcagtagtggtgtcttttttcgttttatttttttcaaacacttttaacgatgtcgcgtctacgtttacgacaatcgatacatcctccacgccgataatcgtttcaaggatttctttcagctggttttcataatctctctcgtaatcatcgatcgtgtttttggcgctgctgtcttttgacgccttaaaaacgggtgcgcttttttgcccgctcttgtcttccgtttggccggacatgacagtctgcgccgtttggtccttcccggttttctcaggtgaagagaacatctggctgaccagcataaaagataccccgagcacaaacacgaacagaaagtaatgatattttgtcagttttggtttttctccgtctttcgcctgtccgatcatcagctgttttttgagtatgttccatagtccgtttttattcatggccgtttttctccccgccttccatataaaccgtaattttctcactgccgatttcccatatatccgcaagtttttctttgatgtgtgcagcctcctttttgtcggctgcgccttccggttcgtatttgcggtctgtgcggatgtcgatcggtgcgacggtttgcacggttttttcagaagatggggccatatacacgctgatcgtttttacatcttcttctgaacgaacctgttcttccgctgtaaggcggatgtcatctattttgtattcgtcatgactgaacatctcctccgctttcttttttagttggacagccatttcttctaaaacatatgcgcggtttgatgcttgtatttcttttttttctgatttgatttgattttttatgtcagcggattgaaattgctcttgttttgtcaaataatcgaagatgatttccgggtctgttttgaaaagtttgaatatcgggttgagcatgacaatgattaacagcaggctgacaaccatctttgcgtatttttgcatactggagctgggcagcagcatgtcgatgacgatggcaaataagataaacaaaataatgcttgtcagccattctgttaaaaagctcatatctaatgggcctcctttatttcatcatcatggtgaggttgcctgctgtaataatgactgtaatgctaaggaaaaacatgagtgagacgatggcgagcgccgcgaaaatatacagcacgcttctgctgatgacgccgagacacgtaatgacgggcccgcctccgagcggctgcaaaatggcggccgcgagcttataaataaaagcgagagagagcactttaattgccggaaacgcggagatgcagattaaaattccgacaccgaggattcccacagtgttttttaataggagtgaggcgctgattaccgtatcggtcgcatccgtaaacatccggccgagcacgggaataaaattgcccgttataaattttgcagtcctgagcgtaatcccgtccgtcacggcagccgaagctccctgtacggagatgacgccgagaaatacggtgaggaatacggcaagcgcgccgatcgcgatatttctgagcagattggcaagctgcgtgactttgtattgatccgtcatcgtgctgacgatgcttaaaatcgctgacagaaagatcagcggcatgacgatgttttgaatgagaaggccactcgtattcatcaggaataatataacggggtgaaaaaaagcagcggagacggctcccccggaagaagccaaaagcgcgagcagaagcgggatcagcgcgagaatgaagctggtcatcgtctgaatcgcttcactggcataattgacggcaacatgaaagctgtttaaagcgagaataatcagcaccatataaacgatcgcatacgccactttgctgacggtgctctgctgaaatgcattttgcagaagctgcagaatgacacaaaaaatggtgagaaggatcaaagttcccagaagttttccgtttgcgagcacttcatgaaacaggtaggaaaataaggccttcagccacgcctccggcgagaacgttttttctccgttaataaagtcgatgatgcttcccttttggctttcaggaagaagaccgccgtattctgtcataatatcgtcccaaaactttccgataccttctgttttcagcgcttcggcctgctttttcgccacttcatcagccgattcttgatgaattgcggtttcccgcgccgcaccgtccgttccggcagcttgtacacattcagtctgaaaaaataagaggataaacaaaaaagcccccgcccaccgaaagcgcttcattttttgtgccccctttccatttatgatcaagaaggaataagtccgagaatcgtttcaataataacagtcagtatcggcacagccatcaccagaatcaaaatcttcccggccagctctattttcgaagcaatcgctccctggcccgcatcttttgtaagctgcgctccgaattcagcgatgtaggcaatgccgataatttttaaaatggtttccacatagaccatattgacgtttgcattgacggctattttttctatcattctgataatgtcataaatctggtcaacgagataaagaaagatcacgcagccgctgaagacgacaatcataaacgcgaaagtcggtttctgttcttttacgatcagggagagaaatgtggcgatcaggcctaaacctacaatttgaacaatctcaatctgtaagcccccctatccttggaatagaaacacagctttaatctttttaaacaggtcatcgacaatcgtcgccaccataaataaaatatagataaagccaagcagcgtcacccattgggcatattcttttttccccatttggtccagtatggtatgcagaaacgcaaccacgataccgactccggcgatttgaaaaatgacatttacgtcgactcccattttatgtttgctcccctcatgtttacatcaatagaagaatgagtaacagtccggctaaaaatcctaaacttttcaccattttttcatttttcgcctgcgcccgtccggcatccgcttccgccgcttccaaatgtgtaagcgcaagcttgatatgtttctgctgagaaacccggtcatgaagcccgagcgtctctccgaattgcttcagcacatcatattcgctttttttcatcgccatggaaggccagttatgcttcaggctctgttcccaggccgttttggcggaatcgcttccctgttcaagcctttggctgaaagcttgaaacaatagtgacacaggtttggaaagctgtctggcgatgtgtcccgaggcggtgtgcagcggcgtatgtccgtacataatttccgcttcaagcgattgcagcgccgcacgcagctgacggatctgcctcggcctttcaatatagattttggcgatctcaaatcccgtccatgtcgtcgccgtcagaatgaacacggcccccaaaagcttcagcatgtcatcacgctttcagcatgcggcagctgctccccgtcctttccgtacatcctgctgatcgtgccgggaccgcggcgccttgacagttcaacataccggtcaaacactttttcctcccaaagcattttcagcgacggtcttttcaccaaatctttcatattccatccgtgcgcagatacgataaccgatacacccgcatggagcgcttccatcagcgcttcagagtcttctattctcccgatctcatccacgatcatgacatcaggactcatagagcggatcatcatcatcagcccttctgccttcggacaggcatcaaggacatcaactctgcggccgaaactgtgctggggaatgccccgcaggcagccggcaatttccgaccgctcatcaatgataccggtctttttcgccggaatgcgtttcgatccggtgctggaaagccgggccaaatcacgaagcaaggtcgtttttcctgtttgcggagggccgatgatgagtgtgttcagccagttttctttccataagaaaggaataagcggttctgcgattccaagcttctcccgggcgattcgaatattaaaagacgtaatatcccggagccctttgacggctccgttttcgacgatgactcttccggccagccccacccgatggcctcctctgattgtgatatatccttttttcagctcttcttccagcgtgtacatactgtaattgctgagccggctgaggatcagctgtgcgtcgccggccgtacagatatatgacaaaaacaaaggttgtcctttccggatcagttcaaccggcctgtcgacccgtatcctgatttcttctgtatcccgccatgtttcttctggtacggcggagatggcatgtctcaataattcagggagaacctctgtaatttcattcaatagagtctcctccttttttaccgattggcttctttaaaatgtatgatccgggacagactttatgacacccgggcctctatttatgcacacccgctaaaatcagcaccacccccgcaaaaatcaaaatcaatttagcatatgagagctgtccggcaatctgataaatgccgatcgtcatcgtaatgataaaaatcagcggaccgacgatcgccaaaatactattaaccacaaccgcttttctgatgtcgtttgtgataatcataataatggcggccgataattcaatgagagaggacaaaactcgtaaaccggccatcgttaaaacagtagaattgattgaaccaaacaagaatttcattgcaatcccccaacttcaagcattttgttacactatatgctctagctgacggaagtagtctcactattttcatatagaagaaagattctgttttaaaacgcaaaaaaagcctgccccgtaaaaggagcagactccgaattcctttgactacgctcttgacacgtaagagccgtctgatgtatttacaacaagcgtatcgccttcgttcacgaagaacggtacgtttacgacaagacctgtttccgttttggcaggttttgtgccgcctgacgccgtatcgcctttaattcccggctctgtttcaacaactttcagttcaactgtgttcggcagttcaataccgagcgtttcagattgatacatcatgatgtgtacagacatattttccagaagatattttaattcttcttcgatttggtttgcattcaattcaagctgttcatacgagcttgtatccatgaacacgtgctgatctccgttggcataaagatactgcatcgtttttgtttcgatttgcgctttcgccactttttcacccgcacggaatgttttctcctgaatagcgcccgtacgcagattacgcaatttagaacggacaaatgccgctccttttcccggctttacgtgctggaagtcaacgacgcgccaaatgccgccgtctacttcaatcgttagtcctgtacgaaaatcgttaactgaaatcatgtttgatgtcctcctatattccaatcacaaaataattaattctttaggggaatgcgtaattgtccggttgccgtcctcagtgatgatgatatcatcttcgattctgacgcccccaacttccggtatgtatatgcccggctcaaccgttaccgccatgcccggctcaagaacggccgatgacctgaaagacagtcccggggattcatggacttccattccgaacccgtgtcctgttgaatggccgaaatactgtccgtagccttttgcggtgatgtgatccctcgtcagggcatccgcttcttttcccgtcatgccgggtttaatatgcgaaacaccgagcgcctgggcatcgtatacgacctgataaatttctttcagtttatcacttggctctccgaccgcgacggtgcgtgtgatatcagaacaatagcctttataataagcgccgaaatcgagcgtgaccaagtctcccttttcaatcaatttgccgcttgccactccgtgcggaaggctggatctgactcctgaggcgacgatcatatcaaaggaagagccatctgctccttgacgtctcatataaaattcaagctcgtttgcgactgaaatctctgagatgccaggtttgataaacgtcagaatatgttcaaacgcatcatccgcaatcttcgcagcttcctctaatatcttaatctcttcacttgacttaatcaagcgcaacttttcaacggaatccgcgacgggaaccatctccgcttcttgcagcaccgcttggtaggatgcatatgttccgtacgtcaggctgttttgttcgaagccgagttttttaatgccgtactcaagaatcgtgtccgcagccgtttggattaagcttccgccgtgctcgataatttcaaagcccttcacttgcgccttcgcctgctcggtgtaacggaaatccgtaataaatgccgcacgttctttcgatatgaccgccaagcctgacgaacccgtaaatcccgtcatatactgcagattggcggagcttgtcaccaagattccgtctatatcgagctgaccgaaaagatttcgcaatttctcaagtttcattccctttctcctcctcgccgattcttgactgccgcctgacaccgggagcatccccgcccggttttcagcataaaaaatgttcacttctcgtgaacattttaccataccggacagggattatacacttattcacttgttgccgagcgccctggcaagcttgtctgacgtaagttcattgtaggcgaaggaaatcgagtagccgacaaacaaaccatacagaatataaaggcaaagcgtcgtcacgattgtatctgatttcaattcagtgacagacttcacatcttggaaaatcggattgaataagaaaaaaaccgcgcaccataaaatgacgccgtacaccatccccggccacatggttttaaaacgcttcaggcagacgaaataaataaaagctccggcaatcgaaattaacccgatgacaacgatgctgaccatcgtgccgagccattgttttttccattctccgatcataaacggctgaagaatcatgttggggctgatctctgaaaaatgaaagagatacccgagatagccgatcaaactccaaaatacacccccggcaaatccgataccgcaaattctgccggtaaatgatacaggctgctgatcttcatcctgcttgtttttttcttcctgttctgaatgtttttcgctggtcatcatggcacctccagtcatagaatgccccaaaattgaaaagtcataaaaagttccgccatattttcaatcaatgagtaaaatcttagaaaacagggtatactgcttgtagaaaaagcattgattttccggctgtctaactagaggtttaccgctgtttcctgtacaatagagtgaaaggaaatggttagtaaatcctaagaaaacaggcaggttgataaacaatgtccacacaaaaaacgccgcccgcatacggcggtcaggctgtcgttgaaggggtaatgttcggcggcagaaaaaattatgttaccgccatccgcaggaatgacggaagcattgatttttttaagcttccgagagtgccgaattccaagctttcggctttaaagaagattccttttttgcggggaatcatcgcaattattgaggcaagcgccaacggcacaaaacatttaaacttttccagcgaacgttacgggcttgatcctcaggatgacgccaagctggaacaggaagataagaagggttcgggcttatcaatgtttttcagcctggcggtgatcggcgttctatcgtttttgttcagcaaattcgtttttacgctcgtcccggtctttttagcggagcttgtaaggcccgttttttcctcagacgccgcgcagatcggaatagaaagcgtgtttaagcttatcctgcttctcggctacatttattttttatcaatgacgccgttaattaaaagagtgtttcaatatcatggagccgaacataaggtcataaactgttatgaacagaatttgccaattacaataaaaaatgttcagaaacagtcacggcttcattaccgttgcggttcaagctttatcttatttacgatcattgtcggcatgttcgtctatttactcgttccgacagatccgctttgggtgcggattttagacaggattgcgcttatacccgtcgtcctcggcatctcctttgaagtgctccagctgacgaacaaggtgcggaatatccctgttttgaaggtgctcggttatcccggcctgtggctgcagcttttaacgacaaaggaaccggaagatgaccaggtcgaggttgccatagaaagctttaacgagcttctcagactggaagacatttcagaacagagcgaaaagccgtctgacaacgtaatctgaaccgttacctgttattattttcggaggtgggcagttatgaatcatcgtgtacaacctttttttgctgtattaatagcgcttggtgcatttggtttcatttatgcggcggtaacaaaccccgggcagatgatctcaagagcgattaccgtcattatcgcaggcgtcatcatttattttatcgtgagatcggttctgaaccgccgcgccggccgtgacggaaccgctttcaaaaaagcggccaaacaatcgcggctccgaatgaaggagcaaaaagcgaagcatcgcgccgctcacagagggcgggtcagccatttgcggagcgtgccgagcagcagcagaccgaagccgatgattcttaagaaaaaaagccagacccagcttaccgtcatagaaggtaaaaagaataaaaagaaaaacagagcgcttttttaatagctccattgcttcaaaaattgctctgttctgctttttcctagctcaatgagagctagttttttttgcggtgtgagatgaaactccgtcgccatcacattttccaccggaataaaaataatattctgttcgtacttcgtcgcgatatgcctggcatcatgagcgtctttcatcgtttcaaacaaagcgccgaacagctcaaaagcgttgcggattgagtttttcgggcgctctttttcgttaggcgaaagcgaaattccgatgaccggccgcctgcgctctttggaaaacagccaaatcgggaaattgcttagcacgccgccgtcaacgaccgttgaggtgcctttatcagtcttcagtttaatcggctcaaaaaaataagggatgctgcagctcattctgacagctctggcaactgggaacatctccggatttaatccgtagcggggaaggtcgtcaggaagcacgatcatcgttccgttcgtcagatctgaagcgatcagacggagcgatccttttttcatatcgccgaacgcgatgatgcccttcgcttttaatttatccgcaatccatttttccagcgtatcgcctttgtataatccaaggcgccaatatatcgacacccactgcaggatattcagcgggaggaaggaatatctctgatcaagcaattgtcttccgtccacctcatctatgatggaatgaacctctctgctcgtgtagcccgcagcgataaatgcggcaataatcgcgccggcgcttgttccggcgagtctttcaaaacaatagcccttttcttcaagcgcttcatacgcgccggcaagcgccaccccttttatccccccgcccgaaaatacgccgtcaatctgcatacgcgccctctcccttccatccaaggtgtattattattttaagaaacggcttggtgaaatagaccaaagaatgaagacattaaaaaaagggcgccctatttcgggctgccctttattcaccgggattttcggtttttttctgtacggatttcaattcttttttccggctgtcgtcatcttcaaaatactgaacgagatcgccgatgcggtcaatgctgttccagctcagatgatgttcgattccttctacatcattgtaaatcttctcttcatcaacaccaatgattcttaaaaactgctcaagcaattcgtgtctgtatacgaggcgtttgccgatctttttgccttttgacgtcaatacgagcccgcgatatttttcataaatcaagtactcgtctttatctagtttttgaaccattttcgttacagaggagggatggactgccaaagcttccgcgatatcagaaacccgtgcatatcctttttcttctatcagcatataaatctgttcaatataatcttccatacttggtgttgtcatcgtacccctcccaaaaagcaccttaactttataaaccattacaagtttacactaacggtcatgaaaaaacaaggatgcttccggtctgtcaagccttaatcagcgcttataattccattcgtcagacgcgtatttcgtctcggccagctcattgacaaacgcaagctcttccggcgtgagtgtgtaaggctcaagatgaatgttcaggccttcctcaaaaccggctttaaaagcgattctggcttcatccatcgttaccggtttttgcgctaaggcgttgatggctaccgctttgtttttgaaattccgctgcatgcgctcacggactctgtcgctcggatataaaaacagatcaaacagcttgtcctcatcaatgtcaagcaggatggagccgtgctgaagaataacgcctttttggcgtgtctgcgcgcttcccgccactttccgcccttcgacgaccagctcataccacgaaggcgcatcaaagcagacggacgagcgcggatttttcaggctttctttttccttttccgtacgcggaatcgcaaagtaagcatcaagcccaaggtttctgaacccctgcagaatgccttctgaaatcacccggtatgcctctgtcaccgtggccggcatttccggatgatcctctgaaacgattacgctgtatgtcaattctttatcatgtagaacaccccgtccgcctgtcggtcttctgacaaacccgaggccgtgtttatgtactgcgtcaaagttaatttccttcttaatattttgaaaatacccgacagacagcgttgccggattccagccgtaaaaacggatcaccggaggaatttttttttggctgtgccaatataaaagcgcttcatccagcgccatgttaaatgccgggctttcattccctgagtcaataaaccgccatgtttctttttccatacactgaacccttctttatcgttttaataaaatcagtttaacaaactgacgtgaaaatgaaaaatatttcgtttcattaaggatgacaatcgcttcatgctttactataatagtatttgtcccaaaacgtccggtaagccttgttttcacaagcagggtttttgattttataagctaaaggagtagaatcgcattgtctaatatgattgctttaattattgttgcggcgtttatcgtttatatgatcgtgtcgtatttttaccagcagcgtttaatgaaaacacttacggaagaggaattccgcgcgggctacagaaaagcgcagctgattgacgtccgtgagccgaatgaatttgaaggcggccatattctcggcgcgcgtaacattccgctgtcacagctgaagcagcgcaaaagcgaaatccgtcctgataaacccgtttatctgtactgccaaaacaatgtccgcagcggacgcgcggcacagacgctccgcaaacacggctgcaaggatatttacaacctgaaaggcggatttaaaaaatggggcggaaaaattaaagcaaagaaccaataataaaaaagagctctccgttttatacggaagctctttttttatacccgtcagcggctgccggcagatgtatgttcgtattttaaaaccggctttcttgcggccttggtttcatccattcttttgacaaccgtggtatgcggcgcctcctgaacggtctcaggtgattcctccgcttcccgcgcaatttgaatcatggcatctataaaggcatcaagcgtttccttcgattccgtttccgtcggttcgatcatgatgctttcttccacattgagagggaaatacacagtcggcgggtgatagccgaaatctaaaagccgtttggcaatatcaagcgttcttacgccgagctttttctgtcttcttcccgataacacaaattcatgcttgcaatgacgggcatacggcagatcataataaggcgcgagtcttctcatcatataatttgcatttaaaaccgcgttttcggtcacagcttttaagccgtcaggccccatggagcggatatacgtgtaggctctgacattaatgccgaagtttccgtaataaggctttacgcgcccgatcgattgcggacggtcatagtcaaaagtcaaacggccctcttttttcgtgaggacgggtttcggcaggtacggaatgaattctttctttactccgaccgggcccgagcctggtcctcctccgccgtgcggcccggtaaatgttttatgcagattaagatgaacgacgtcaaatcccatatctcccggtcttgctttacttaaaacggcgtttaaattcgctccgtcataataaagctttccgccggcctgatggacgatatcagccatttctgtaatattttcctcaaataagccgagggtgttcggattcgtcagcatcagcgccgctgtttcttcatttaccgctcttttcaaatcttcaatgtcaaccagcccgtgttcatttgacttgacggtaatcgtttcaaagccggcgaccgtggcggatgccggattcgtcccgtgggcagaatcgggaacaatcaccttcgtccgtccgaagtctccccgtgcttcatgataagcgcggatcatcatcaggccggtccattcgccgtgagcgcccgccgcaggctgcagcgtcacctcgtccatacccgtaatttcctccaagtgtccgcttaaatcgtataaaagctcaagcgctccctgaaccgtgtcctcgtcctgaagcgggtgaatggctgaaaagcctgggaaccgggcaattttttcatttaatttcggattgtatttcatcgtacaggagccgagcggataaaaacctgaatcaaccccgtggtttctcttagaaagtgcggtataatgccgcataatatcaagctctgatacttccggaagctttgcgtcttcattgcggatataatcacccggaagaaggctttcaagctccgtttccggtacatcaagctccggaaggctgtaaccgacacgcccttcgcgggacatttcaaaaataagcgtctgatcttgattattcatgttgatcccccaatcccgcaataagcgaatcgatctcttcttttgttctcagctctgtgacggcaatgagcatatgctgcttcagttccggatacgctaggcctaaatcatatccgccgattatgccttgttgtaagagcctccggtttgcttccttgactggctcattcagcctgactgcaaactcattaaacatcgggccgtcaaacgctatgtgcaagccggctttttccgcttggcgtctcgcgtaatcagctttcagtatattttggcgggctatgtctttgacgccgttttttccgagcgccgtcatcgcaactgaagccgctaaagcgttcagcgcctggtttgagcaaatgttggaggtggctttgtctcttctgatatgctgttcgcgcgcctgaagggtgagaacaaagcctcttcggccgttttcatcctccgtttggccgacaagacggcccggcaccttcctcatcagttttttcgttactgcaaaatagccgcagtgcgggccgccgaacgccgcaggtatgccgaatggctgcgcgtccccgacgacgatgtcagctccgtatgccccgggcggtgtcaaaataccgagagcgagcgggtttgaagaaacaatcagctggctgtttcctttatgtgcgagcggctcaatgtcctttaacggctcaatttgtccgaagaagttcggatactggacgatcacggcggccgtttcatcgcaaacggcatcctctaatgcttcaaggtctgtgacgccgtttttcgcgggcacctctactacctcgatatattggccttttgcgtatgttttcaggacatcccgtgattccggatgaacggccgcggaaatgacgatttttttctttttcgtatggcccgacgcaagcatcgccgcttccgccaacgccgtccccccatcgtacatggaggagtttgcgatatccatccccgttaactcacagatcatcgtttgaaattcaaaaatcgcctgcagctctccttgtgaaatttcaggctggtaaggcgtatatgccgtgtaaaactctgaccgggaaatcacatggtcgacgataaccggctgatagtgatcgtacacacctgcgcccagaaaagatgcatatgtaacagcgtccttatttttcgctgcaagctttgtcagctctctcgtcagctctgtttctgattttgcttttttaatttggtagtctttttgaaacctcacatcttccgggatatcggcaaacagttcatcaattgtttctgcgccgatggctttcagcatttcttttttatcctgttctgtcgcgggcaaatatcgatgcttcatatgactctcctttttcagctctgttttggacgtttataaaacggtgtgcggacaatcttcgcttttaccgtttttttgcggatttccacttctacttccgttccgatttcactgaattccgttttgattaaggcaaggccgatatttttctttaaagtcggagattgtgtgcctgtcgtgacttcaccgattgcaacaccgtctttttttacggcgtatccgtgtctcggaatccctttttcaatcatctcaagcccgaccagcttacgcggagctcctttttctttctgttcactcaatacagacttcccaaaaaaatcggaatctttcttgtgctttacggcaaatccgattccggcttcgatcggcgtaatgtctttcgtcaattcctgaccgtataaagcgagcttcgcttcaaatctcagcgtatcacgggcgccgagaccgcacggaacgagcccttcattctctcccgctgcaagaatctctttaaaaagatgaaccgcgtctccgttgcggcaataaagctcaaacccgtcttcaccggtatatcccgttcttgaaagcaggacttggcgtccggcaacgtccgcctcatcaataaacgtaaacggctttaaggaagccaaatcacattcagtcagcttcgaaagaaccgtctgagcattcggtccctgaacggcaagcagtgaaatctcgtcagactgattcgttaatgtgacatccccttttgcatgttccttcagccaagcgaggtctttttcaatattagacgcattgattacgagcagatagcaggtttcgcttttctgatagatcagcaagtcatcgaccgtgcctccgtcgggataacacatggcggtataaagcgcgcttttcggctttaagtcggcaacgtcatttgtcatcattttttgcagaaaagacagggcgtcttgcccggatacttcgacttctcccatatgggacacatcaaacaggcccgcttttgtgcggacggcttcatgctcctctttaatagaagaaaattgaacaggcagctcccatcctccaaaatcaatcgtttttccgccgtattctttatatacgtcataaagcggtgttcgtttcagcatcatcttcccccttcagtcattggcgcattgtaaagacatataaaaaaggacagagaaacacctcatgaaaatgaaggtttctctgtcccggcacctgaaagtttactttatgaaaacatcataaagacgtcccctttggtggtctgccttttctgctcgcagacactctccagagttgcgtcgagcaagagttcttttgcctgagagattcactccgcagtttgctccttcggcgcccggatgcacatctttcttccgagtctctccccttgctgtcattcgctcatatttaccaattgttatggacatactaaagcaatatcttgggtgaaatcattacttatatcctaccaccctcacttacgtccggcaacaaaaattatgataaatcagttttttaaaagaaaggcggttttgttacatatgacagcagagatcatatttgatgcaaactggccgggagagttttctgagcggctgaaaacggacggtccctggtcaaattgggagttgtacaaactgtcggctgaagtccagcagactcttgccattcctgaatttgaagggttgagggctcctttatacctgcccgatttcactccgcttccccatcagcttgaagttgcccagaaagtcgttgaaaaaatgaacggcaaggcgattttggctgatgaagtggggctcggaaaaacggtggaagcgggcctgattttaaaagaatacatgattcgcgggctggcaaaaaaaatcctgattcttgtgccggcatcactcgtttcccaatgggtgaaagagcttcaggagaagtttttaataccggctgttgaacagaagaaaagctatgtgtgggaacagtgcgatatcgtcgtttcttcgattgatacggccaaacgctcgcctcacaaggaaattgtgctttctattccgtatgatctcgtcattattgacgaggcgcacaagctcaaaaacagcaaaacgaaaaattatgaatttgcgagaagtcttgtgaagaagtactgcctgcttctgacggcaaccccgatccaaaaccggatcgaagaaatttttaatttagtgtcactgttaaagcccggccacttgggaaatgaaagcggatttcaagaaaccttcaatcaaaaggacggaattgacgctcatgagcatttgaaagagctcgtcaataaggtgatgatccgaaacacacggagcgacacggggcttacatggacgaagcgccacgtcgaaacagtgccgatcaccttttcaccgacggaacaggcgctttacgatgacattgccgcactgaaaaacggcacggaaaagccgacaagcgcattttccattatgacgctgcaaagagagtgctgttcaagccgggaagccgtgtatatgacgcttaaaaaaatgcttgatcaaaaggagcaaaaagcgcccgcattcgatgaacagacgattgcgaatttaatggaccgcatcaatcaagtcacgcaaaactcaaaagcgatccaagtggttgacttgatccaaaagattaatgacaaggtcattatttttactgagtaccgggcgacacagatttacctgcaatggtttcttcagcagaacggcataagctctgttccgttcagaggcggatttaagcgtgggaaaaaagactggatgaaggatctcttccgggggaaagtgcaagtgctgatcgctacggaagccggcggcgaagggatcaacctgcaattctgtaatcatattatcaactatgatctcccgtggaacccgatgcggcttgaacaaagaatcggaaggatacacagactcggtcaggaaagagatgtccacatttacaacatggcgacaaaacatacggtagaagagcatatcttaaaacttctgtatgacaaaattcatttattcgaaaatgtcgtcggagaattagatgacatattaacaaaaatcaaagtgaacaattttgaagaccacttacatgatattttatgccactcgctgacagaggaagaaatgcgaatcaaaatggacaatcttacctcttttctatcgtacggtacggaaaagccggccagaaaaaaaggctcttaatctaaaggaggaagcgcgacatgagacagcaggaggttcacgaatttttactgcgcttttttgaagcgaaccactgcccgattactgatcacgggccgggttttatgacggttcaattgacggtcgagatggacaaacaaattatgaaccggccgttttattggcattggcgtgaaaaaacgggcggagaaccgaacccgatgaagatcactttcatcactgataaagaaacggctccggatgatatggacggagaatttatttacttcggagccccgcggctctttcaaatctttcaagcagttaaacaaaatgggagatttacaagaatatatgagaaaattgtatcagccggagccagagtgccgcttcagccctggcttggattaaatgtagtgatttcataccaatccgacatgaaaaaagacagacttttgtctttaggcctgcatcttgtatctggaacaattatagaaggatttcagcagaagcttgcaccgcttccgctgacatcacaaatatcagactattgctttaccatatcgccgatgattaagccggaaagcgggattaagaggatggagcattatttgaaaaacgctgccgccaaagagccgtcagactgggctgacaacgcgatcgccagatggaagaaggacctcaggcttctcgatcagttttatgagcagacagaggaaaaacctgaggaataccaattggaaaaacaagcgctgaaagccttatatcagccgaaaattcacattcagattgagaacggcggtttatttttcctgcaaagtaatttttctggataagagttatccattcgacagctttcccgttttttttagaaattctatattataataaaggtatatagaaaaaatttctggcgtttcgcatgcgatgaatcacttccagacatgaaataaagataaggtcatggccggattggctgaaatacataaacaagtattttaggaggagaaaatgcatgaaaaatgcaaaaacagagttttcgcaattagataaggaatgggttgaactgatattagaagcccaaaaagcaaatatcagcctagaagagatacgcaaatacctgcattcgcataaaaagtcttctcaacatatccaggccgccagaagtcataccgtaaatcctttctgaatgtgctataatatcacaaggaaggtgatgacattgattggccagcgtattaaacaataccgaaaagaaaaaggctactcactatcagaactagctgaaaaagctggggtagcgaagtcttatttaagctcaatagaacgaaatttacagacgaacccctccattcaatttctagaaaaagtctccgctgttctggacgtctcggttcatacattacttgatgaaaaacatgaaaccgaatacgatggtcaattagatagtgaatgggagaaattagttcgcgatgcgatgacatccggggtatcaaaaaaacaatttcgtgaatttttagaatatcaaaaatggagaaaagcgcaaaaagaggagtagtgccgccatatgtgcacaactcctcttttatctgtccggcattcggatcagtttttatcctcactatgagccttttcattttccttcacgtaaccgtctttatccgtatggtctttcgtaatggtcaatccgttccattgcgttgcttcaaatgagaattgaagagaaatcgcattgccctggaatttgttttggacactcagaccgtttgcgtcttttgcggtatcatttttaaatcggatttccatccgcacttgatcataatcaacaggcgttttcggaactccgtcgtactcaggcgctgttttgccgttaatggttgctacattgacttttccgctctcactcaagaacttcggatcaatatgcttgctgatcgcttcagccgctgctttatcctgctttgcagacattaagtataagtctttcaggctggccgccttcaaaatgatatttttagggtagccgttgcccccttctttaccgactgtcagaaccgtaatttcaaactggctgaggaaatcctccgcagattcgtttcctttctttgctcctttgaagtcagtaaagttcaaagccatcagcacttctttaatggcaagtgaaccgttgtttctgaattcaaaatcttttgtcaatttgtcgcctggttttaagtttgacaaattgacattggctgattgttctttagccgataaatcaagtgttcctgacgcaaatgtggcgtccgtggacttcacatcattaaatgcggcccatgtgcctcctcctactaatgctaaaccgagtgcggctgaggcaacgcccaagcttaatttctttttcatacccatgtttgtactccccttactttttcattttttgttatcaaatcctgtcgccaggttgcaaccgtattcatgtggacatggtcccgtttctctcatgttcctccagcgctttcgtcttccgctcgatatcgcggagagcgcttgcaatgactgttattgagtaaattaaaagcatgacgccgggaacgattaacagaatcgccgttccgatcggctggctggccaaatgtattacatatcccgcatacgggagctgatatcccgtatactgggccgccactttttcagcttgaacgggtgcggcatccggagcggcattatggtctccttttgtctcaaacaacaggcggccgcccttttttgtgatcccgattattctgtgtgttacgactgacccgtcatcttgtgtaaaagtgatgacatcgcctttttttaagtcattcacatcagaaattttctttaccgctatgagtgaacccgtcttaaattccgggtccattgaacccgacagcacggatttcagcgtatagccgaagatggccggctcaccgccggaagcccgggtcgagattaccgtcaatgtcagcacaataatcaagctgaagattacggcatacaaaatattactgatcagtttcagtgtttttttcatgttcttccccgctttcttttgccggctcagccggttttttctctgttttcttctgatcggaagccgtcgcctgttcttggcacttaacaagcttcatcggttttgaccactcaaatttttcttcgttcgcaggatatccttcaggcttgtaaaccttgaatgcataaattcccggctgcaaggcccgctttgactccattttataaatcgttttgctttttttatcagtaataagccctttatccacgacattgccgttttgtaaaggctgttgctgagaggcaattttatggagctcccatttccagtcagaaacagtccgctctttccccctgttctccagctccgcataaagttgaagcggcgcacacacggtgcctgacgtatcagtttgatttgtgatatgtaaatcactttgatcccagcgttcgtcataacggcaattgtcatctgtatatcgaaaatctccgcacgtttgaaccgggagactgaagcttttcacatcattaaaggaggaacttgtgtctcccgtaaactgagtacatatcgtcacgggcaggcagaaaatgaacgacagccgtaaaaacagcatcattctcgatctcaccttgccctttttttccggtcgcaacaatcggaacatgccttaccccctgtaaaactgtttataaatatgatattcgttctctttaaagaaccgcatgaacaaagtataatcaaggattatcgtattggaaaatgtcaaaaacgatcaaattgttcgtttttaagaatatatcctttaaaaacaacgttttgctccaaattacacacctttttggaattttttctaataaaatgtgagaaaataacggagtgaccaacacaaaatggaaactatatacagcgaaaggacgaagaatgatgatcaaacaaagtctgatttgcctttcaattcttggtttcggagtttcagggacagctcaggcggaaacggtgccttattatgctgttcaccataaatcaaaatgggaaaaaatcgcagaaaaagaagctaaaaaaagatatccgctcgctcaaacgttatttattcaaaaggtgtgggatcggaaaagaacggatgaagcagtcaaacaatatcacttgacattgcgggatggcgctaaagaatttggtgtgtttgttacgatttcttttaatccctacagccaaaaggtaaataaaattgcggttattgaggaataccaataaaggccctcctatatcaggaggacctttcgggtgttgcactttattttttccgctgcatccacagcttaaaaccatacggcaatattccgaaccagtgttgagaagccggcattttcttttctttccgcacttcttttcgctcttttcgttcctgtttcggcgtatcgaaatatttaacgaattgctcagtcatatattttacataatcgtttgttttcatggctctcacctcatactgtctttattatgaagtgttgtcccgccgcctcttttttatacttctgtccattgaatcagctgtttcttcttatgattgaataaaaggtgagcctcccgtctcgtccctgatgctgttaccgcctttattgtaacttgaaccgtttcccggcgatcgttcccgttgatgtaaaaggagacggttccgtacggaaaacgctgtgtgcccgactgagtcttttgtccctgtatcatatgacggcttgacagcagtgcgccgttttgaagcaggttctcaccgatccagtactccccggcctcttttgcaaatgtttttcgggtgatgaaatcagatgaagtatagctgatgacaagtaaaactgcggcagaaacaaacagaaccgccggatatataaacccgtcagatttgtacattttaatcaccttttaaagagctgtaaaccggaatggccgtctgcttctttttacctgtaacgcttgtgattcccactaaaatcaggccgtttttcacatcagccgttaatgaagcagcgttatgcaggatcggcacatggccttttccgttcactcttttccttatcatcgtgtgatagatttcaaaacgcacttcttcgcctcctgttttcctgcaggttaacgcccgtccgccatctgcaggctccacagtctcagcctgtttacattcattcataatctgctgaacggcaatatgatgctcccggctgtctattcctccgttatcggtccggcctgataaaaacaaatgtaaaatcgggctcagagtgcctgataagaagagacagacggccaaggagaccaaaacattaagaagcgtaaagccagtctgttttgagaatgctgaggcacatttctttttcgccgcggacagctgcacagactttgtaataatcaccatcctccttccacgtcacatcgggagatggctgcttttttccggacatcatatatgcgctgatatgtttatgaagaagctggtacacttcctggtgttcttctattttcagattgtctgtcagcatgcccgtccagaccggaacgatagaaatcataaggaacagccaaatagccattgctgatagtgtttcaatagtagagaaccccttatttccgttctgcatggacatttccgctccctaagtaaattgttatttcataagtgaatcccgcgcttttcaattgaatctttccgccggaattcggatggcctttttcgttaaattcaaggctctccggtaaagtcacaagtgtaatgtgaagcgaatcaaaggaacgctcaacaatccttccggctgactgcagcttgtatttatgctcttttgggagaaatgtgatttttgttcttttatgttctgcgatagccgtttcctgagcaagctgaatgtctttttggagctgttctgttttttgccgcacggccagatgggtataaaccggcggaaccgccgtgaacaaaacagtcagcaatacagacgccagacttaacacaaccaggctttcaagaagagtgaatccgttttctgtcagccggttattgttcaactgtaacttccccgccctttattaaaatctgttttccattcgggcaggctgtattctttttgatatatccctctgattgtaagtcggtcatatccggcatttttccttcatggtcgatttcgtacgccgtcacttgggctttcaccatattctgaagtccttcacagcctttatgctgaatgctttgattatgttttgttacgttaggaatcgtgattaaaagcagaatggaaacgataaataaaacgatcagcatttcaattaaagtaaatccatcttgatttttcagacgaagcactcccttacatttggttcatcatctggtacatcggcatcagcattgacatatacacaagtaaaatcataccggccacaacaccgtaaatgacaggctggagaataccggtatacttctccgcattttgttcaagacgctccatcataaactggctgtacgtataaagttcgcgatgaagccggccgtttgcctgtccgtgactgactgcagccgcaagatctttttcataacacggatggccggaaagagcagattctatagtttcaccggccttcaaacgtgtaatgagcatctctgcttcttcacggtaaaaaggcagaaaagattgttctttaaaagcagttaagctgtcatagatagaaagaccggatttcagaagactgctgagctgtaaagagaaaaagtagctgttaaaaagaacggccgcttttcctatcagggggattttcacaacgataagcatcttgtcttgcggggattttttcttacataagaaccaaacgtacaaaaacaagctgagaacggctgacatccccagtgcgcaggcttcatgaaaatgctgaaaaaacgcaaagatgaaagcagtcgcaccggaagtattcatattcattgattgataaatccctgaaaactgcggaataatcaaactttgcaggatataaaacatgacgcagacggaacatattaaaaacatcggataccggagcatttttttgatttgattcgtctgcatgagctttctctgtaacaattcgccgctttgtttcatcgcccccggcaattctccgtgtttctccgcgaaatagcagatcgagacggcttctttatgaaaagacagtgcctcaagcacttggtaaaacgaatcgccttctctcagccggcgaattccgtccgtcagctctgcaagctgacgtttatgcagctggagtttcagcagtctgagcccttcaatcaggctgtatcctttttccgtcatttcaccgagccttttcaaaaaagccgcttggtccttcaacggccaggttcttttaatccgcttcatgatacacccaccgatcataattatcagtcgtgacataaccgagcgcgatgccttttctgatcagcctgcgaagcgtctgatattgaaaattggcgtgctccccttttgcttcttgaaagcactgggtgagattttttccgtaaagcagttcataaatcccagcacggcgtgtctgcctgtatagactgcagtacacggaacagttgtccgttttgcaaaacggacacgttaaatcaaccagacgctgagcggcgatggcaataacggtttgttcaatttccgtcatgttcaccccgaactccagcagcctgtatatggcgcccttagcatctcttgtatgcaggcttgacagtacgaggtgtcctgtcatggccgcgcggactgcgatttcagccgtctcggcatctctgatttcccctaagatgatcatatcggggtcatgtcttaaaatcgcttttaaaccggtggaatatgtgactccggctttttcattcacctgaacttgcaaaacatcttcatctctcgtttctacgggatcttccagcgtgacaatccgccggttgaaatgccgttttgcatagttgacaagcgagtaaagggtggttgtttttccagatccggtcgggccggtaaaaagaagcaggccgtgcgaatgcttcagaaaggataataatgcggcgcctgcccccggaaataaggacagtttatccagagggggaatctgccttttaggcaatagcctgatgacaagactttcatcattcattgtcggcaaggttgacatcctcaaatgaacggtttccgttggaagcggcagagacagtgatccgttttgcggctttcgtctttctcctatatccatggctgataaaaatttaaaatgagaaataagccttacgcattcctctttttttaagactctttttttcacaagagcatgaccgatgcgaaaatgaatgaaagcatccctttccctcggcacaatgtgtatatctgaagcccttgccatataggcctcgttgatgatgttcctgctgtatgtttcaatattctccataagacttccctccttccgacacgtattgtaaatcaaatacacaaaagtgatcaaaggagaaataatgctttttgcacagtgtaaatcgtaaaaaaagcaaaaataagccgcttaaatattgatttactgaaggaaacccggctccattcagcaattttcggccataaaaaaagcaggcgtgcgcctgctctgcttagcgtttcttttctttccgcagatatttcttttgattctccttcagaatatcccctgtccagcccttctgccgcagataaatataaatcagcagggttgatacgattataagcacaatggaaccgatatacgcatatttccaatgaagctccggcatgttatcaaagttcatcccccagagagctccgagcgccgtcatcggtgtaaagagagttgtaaagatcgtcaatgctttcacaatttcatttcctctttgggaggtaatgacttcctctgcgtgcagcagattgctcagttcctgatcaaattcattgatatatgtaatgcctctttccatcttttgatgagccctgaggtaatctttctgcttgtcatttttcgggagaaaagcttcttttaaagccatttccacttttttagctcccagcgtcagccctttccaaatgaacagttcatggcgcagtttatgcacattttccaagattcctttactgttgtcatcatgaatctgccatttcagcgtccgctgcttgacttcaaattcatctaatccgataagataggaattcatcagctcgccgagcagaacaaaaaagccttctatcgcattctcgcatgtttggatctgctgtgtggcgtgcttttcttttatgccgcgcagcagcgaaaaatcaaaattaatcgtaaaaaagaagtctctcgtaatataaaagtgaaatacggtatgatttttttcatcatctaatccttgatgatagattaaagaaccgaaaaccgcttcattattctgatcatttgtatctgagcgcagaaagtttatatggttttcatgttcaaaccacttttcacattgcggccagtgattgtggcggatcatttttttcgcttctgttttttcatgcggaccgagctggtaccaaacccagtccgctcccgaatgtaccttcatctcttgtcagcctccagtatcgctttcttcttttaattaccgtaattgcagcgggctaaaccaggtttgatgtttgaccagctttccagagtggtattattccgaaaaaagggaggtgcaagccttccttctcggaaggcgttccattgtatatcatcaaactgtctgccatcgtactatttattttattaacggcatgttttgtcgctatagagttttcaatcgttaaagcaaggcgctcccgcatcaatcagctcattcaggaagagatgaaaggggcaaaagctgccaagcatgtcattacacaccttgatgaatatttatcggcgtgccaattgggtatcaccgtaaccgccttgggactcggctggctgggtgaaccgacagtcaaagcaatgcttcagccgttatttttaaaaaccggacttcatgaagcggttgcccatgtcctgtcactcatcattgcatttctgctggttacatatgtgaatgtcgtcatcggtgaactcgcaccgaaaagttttgctatccaaaaagctgagcggattacacttttgtttgccagaccgatgattttgttttataagttaatgtttccgttcatctggctgcttaatcattccgcacgcctgattacagccctgttcggcttgaagccggcttccgaacatgaaatggcctatacggaagaggaattgcgggtgctcctggccgaaagctatcgaagcggcatgatcaaaaaaagcgagcttcattacgtaaataacattttcacatttgataagcgcactgcaaaagaaatcatggtgccccggaatgaaatggtgagcctgccgctggacagcggatcgggaaatatgctccgggatattatcaaaacaaataaatatacccggtatcccgtagtaaagggagacaaagatcatgttgtcggcattatcaatataaaagaagttttattcagattcctatcagaaggagctccgtttacaaaacacgagctcagtccttacattcagccggcgatccatgtgattgagacgatcccgatttatcaattgttcgttaaaatgcagcgggaacatgctcatatggccattctcattgatgagtacggcggaaccgcaggattggtaacggcggaagacatcatcgaagagatcgtcggcgagatccgggacgaatttgacacggatgagacaccctccgttcaaaagcttggggacagccgctatctcctaaacgccaaattgctgatcagtgacgtcaatgatgtactcggaacagagattacggctgatcaagtcgatacactcgggggctggtttctgactcagcatattgatgcaaagccagggagcgtgattgattttgaaggatacacattcacggtaaaagaaatcgacagccatcatatcaggacgattgaagctgaaaaagctgaatagctgagggagaaatccctctctgccattcagctttttatcatcttaatgattcttttacgacaaatccgtttttcgccagcgccttcgtcaggctctgttctgttttcacttgagaaaagtcgatgccgagcttcacgacggtttgcgcgatttccggccggatgcctgagattgtcgtttctatgccaagaagttttgtgctgtcaatcactttaaaaatttgataagcgaccattgtgtctacaatcggcacacctgagatatctaaaaataaataggaaagccggagcgaagaacattggtcaagcaccgattccaaaatgatctttgccctgtatgtgtcaatttcgccgacaagcggcataatcccaataccgtcggcaatcggcataatcggcgcgcttaattcattaatcatttctttttgggcgtttaattgcctaatcgtcactttataatattcctctgtaaagacttcaatcatatggtcaattgctttgttcagcttctctccccattgaaataccgcaggcgtcccgggcttctcggacatcgtttcactgcatgtctgtatgcgattccagaccaatctccggaattctttaaagcgcgcgacgctttcatagaccgggacttcatgcacggcccggtctcttgcgaactgcagcgcccactttgtcagttcctcgtccccaccgtctttttccgatataatcctggcaacgatttcaattaacaggcggtgctgcgtttctgctctctgatcatctgaaggccgccccgattcgggtatgagcagccattggcgtgtgatttcacctgattcttcaattaatgcttcagataacacttcatttaaatgtttcacgggtttcctccattcaaatcaaaattactttgtatgtataaattgccgccggacgcacatactgtaattacatccgatgggctatagccaagcggtaaggcaatggactttgactccgtgatcgttggttcgaatccagctagcccagtcctgtaaccgcaaaaaacgaagattagctgataatgtttgatcagcggatcttcgtttttctcttatgatacggattgatgtaccgtttttttcttcgtcagtttcattaattctccgggattatatccgataacgagttttttgtgatcgatcaggatcggacgccgcagcagcttcggtttttcagtcagaagcttcagcacttcatttccagtcatttcttcaagattcaggttgaggtttttaaatgtttggcttctcgtcgctaatatttcatcaattccttcggtcgttaaggataagatttgcttcaattcatcaattgtcggtgtctccctgaataaatggcgctcatgaaaatcaatgttgtgggcttttaaccaatgtttcgtctttcggcatgatgtgcagctcgggtatgaataaaaaataagttctttcatttttaaaaattcctccctcggataatccgtctctttgtaaacataagtaccctgaactttttttcactaaacgtatttcaaaaaaattttcggatcttttgttcagagcggcataagatataaaacacggggaaagacataaattccacaataaatataatcatgaaaatgtttacatttcgactgccgatccattataattaacttcagatagactctcgggaggggataaggaatgaatcgcatgttccgggtgttaggattttggacggggatttttgcagtaatgttttttttaggcggcatgaaggacgcatctcttttgttttttggacagacgatctttttcgtatttctttcttatttgaatctgactgagcggatgtatatttatattttcggagcttacttaaccgtatttttcgccggatttacatattactctatttttattatgacaccgggcggcggaacccactgactaaaaaagacagaccgattacggtctgtcttttttcatttacagtgaaaaaccattgataaacgggtttctttcctgctctgtctggatgtccgtttccgggccgtgcccgcttaacacaagtgtatgcccgggcagtgtgagcaatttttgatggatggaatcaagcaatacgtcctgacttcctccatgtaaatccgtgcggccgatgcccccctgaaaaagcacatcgcctgaaatcacaagatcggcgtcctttacataataagaaacgcttccaggtgaatgacccggcgtaaacagcgtctccaaatggaacggtccgatgtccaaaacgccgtcgccttcaatcagccgatcagcgggccgtgccgtgacggcgatgccccgcaatatgcctgatccgtttaaggaagagtcctccagccacttttcttcatttttgtgaagatacacgggaacatcccatctgtctcttacctcatcaagcgcgccgatatggtcaaaatgggcgtgcgtcagcaagacggcaagcggcttcagattgttttcttttatgtaattgttgattttgtccgcttccccgcccggatcaaaaataagacaggactgatcctcactgacgagaaaatacgcgtttgcctgaatcggaccggccggcattcgtctccatttcactttcatcacctctttatgtatatgcccttattatgaaggttttctgcggaagattcaatgaatgcggccgggaaaacgctatcgacaaataaaatgaaaacggttaaaatgaaatggaaagattttcaggttccaatgacaaagggggagcatgatgttacttgttgtaatcttcggccttgtcgcattattagctgtattaggagtcctgcgggctgtcagacagagaaatatcctgggatttttgttagccgccgccacgctcggcgtgtttggctggtttaccgtaatgaccgttataaccagcggctatccgactgcacattaaaagcctgtatccattaggatacaggcttattttttattgctgcaaatgtttgctgacacttttgattttgctctcaagcgtcgtttctttatcacgtctgtcatcaatgcggatattggtcgccactctgtgcagccctttatggaacggggcttcgtgaatgtcctgaatgactgcaaacaagtcgctcagctcaccttcaatcaaagtgttcatcggtgtgagctgaaatttgattttgccggcagctttgtagccctccaaaatcttttgcacgtccgctacatactcgctgacgctcggtgtttttgttccgatcgggataattgtcacatctgcaattgccatttgattcaaactcctttttcatttgttatgattggttctgtcatacctgttttcagtgaaatcagacggtcatacgtaaagccgtataaagcgtattccccgtccggtgagatctgaatcggctccatttccgtattcgtgagcaccgtccgctcccgttcgtcccctaagtcaaagctgatcagcctgtataaacggccctccggcttaaatatgtaaaaccgcttgtgcgtctgatcgtaatcatattccatcggcgcaaagctctcatactttttttgaagaggaaagcggtgtgtcacggatgccggtttttggaaaaaaaactcgccgtcgccgtccgattgatcagtttgtctgacggcaatcgtcatacccgggcgggaatcggcccagatgacgtgatgaagcactcttttttcttttttcgtctgcaagtcataagaatataaaggaccctcttcttccgttttcccttgcttgatatattgaaattcatcagaagacgtccaatggacaaaaggtgtctgaaccggactcatgtttaaaatgccgtttttcatatcggccgtataggttgtgaagtcccatgtttcagtaaaaacggtaatcatcatttgatacgggtcatacggattccaagccgtctccagctcataagagttaaaggctttgtgataaagtcttttcccctccttgttcataagctcaagctccgtctgcccgctgtttgtcacctgaacgagaatcagctgttttttcgggctgatctttacattgacaatatggccccttgtttcatagagccgttcggattttccgctgaaaagatcatatttcatcagctgatgatgcgctgtatacagaatggttctgttatccagccatccttccgctttctccgcttcatttttactgagcggaacgattttctgttctgctgattttgccgaaacgcctgtgtcatgctgctgatgagatggttcacaggccgctaaacacagaacgaatgcggacagcagaacacaaaacaagtatctcaccagccttccccccattcttttctattgtcccatatttgtttatgtaaacaaatgagaaatttcacagatgtctcaaaaaacgagcgacctccacaaaatgccttccgtcgcttgataaatatcagcaaactgatgaaaaggcaaagggttttttccctttccaagttcaacggtatagccctcttttccgtattgctgtataaaccaatccctaaaaccggcatggctgtcaatggtttttacaccttgatagcggtttccgcttatctcttcaaactcccggatgacctgagcggattgttccggttcatatccttcatatccccaataaatctcttgtccctgcgtatgaagagcgatcaccctgtcaggcggctgttcggttatcagccggtgcatcgcctgcgcttccggttcagtgagcggcgccatgcccggaaaatcccggtacgaaggggctttcggtttgcgcctctgttcaatgtcccaattggacgggaaatgtttatttaaatcaacgccgtttatattcgccttccattcgcggaaatccgggcggtactcatttaattcattgagaaattcacttttttctgataaatcttcacatccgtaaaggacgagatcaacaccgtcgggatttacgagcggaacgaatgacagtgatgtccggctgaatatatcaagcgcggaatacccaaaaaccgtcttatttttgcataacgccgcgcaatattctttacaccattttagcgcaaccgaggtggtgatccattcattggcatgaaaagaggcgtttacatgcacttttctttcggctgtatcctcacctattgtcagctcataaagcggttttcccaacacggaactgccgattttacggcacatgacaaatggaaagacatccgttattttctcaatttcttcaaaaaccgattgagcgccgtacactttttcttccttcacccattgatcactggaaagaacgcttttacagcgccggatgtattgcgaaagcccgctcagcgtcccgatcggaccctctgactgcccgctcacgacaaagccgggacaaaataattcctcgcttttcgccgttttattggcgtctttcaacagtttttcatcaattgaaagcacctttgcgacagctttcatatgctgtttcatttcaggtgtgacacgaattcccgccatgttcatccccctttttaaaaaactatatgacatgggaggtaaaaaaagaaagccgcccgctatatgggcaggcagactttctctagcagttttgatatttaagccattcatttttggcaatccacgccccgccgatgactccggcgtcatttccaagtgccgcaatcgaaatatcggccgcttccgcagaacgcgggaacgcggtgattttgaaggtctcttccacttttgaccgcagtatttctcctgctttcgagacgcctccgccgagcacgattttagtcgggttcatggcgcttgccaggtttccgagcacaaggcctaaatgttttgcgacataatcgacgacttccagcgctgtcttatcctgctgttttgccgcttcgaacacgtcacgtgccgtgagatcgcgcacttgcaggagcgaagagtcggaaaccgctgcaagcttttctttcgcgatgcggacgatgccggttgctgacgcaatcgtttcaatacagccggattttccgcagttgcacggagccccgccttccgggatactgcaaatatgaccgatttctccgcctgccccgtttttaccgtgaacgatttctccgttgacgatgatgcccccgccgactccggttccaagcgtcactaaaatgacatctttagctccgtcgcctgcacctttccacatttctccgagcgccgcgatattggcatcgttttcaatgacggccggaatacccgtttccgcctcgagatggtctttcaagggatagtttttccaccccagatttgtcgtctcataaaccatccccgtcgccatttccacgggtccgggcgctcccatgccgatccattttacgatccgtttcggcttattcaattcttcgagtttctggtcaagtgctttagcgatcgtgaccgtaattgtgtttcctgatttatcggtcggaacctcccatttgtgctgaatttcaccgtacatgttgataaaggccagcttgatggttgttccgccaagatcaatccccgcaaaccatgtctcttccataatgatctccttttcttattaaatcctgctgttggaccttcctttaatccgctctgattcctgttgaagaactccggcggctttcagccataattctctttcaatcacgtttgacaagtacatctcctttaattcatctttcataaagtcaatttcggcttgtctgtcaccgaaataaacgatatggccgaatgacttaaacagctgctgcacgtcataaaatgaattcatcttcttcaccatttctactcttcttatgagtataagcgtatttcatctctgaagcgggagtcaagcaaaaaacgattggagaaaatatcctagcggcattttgataaaatgtatattcataattgtaaaaaaactctcatttatgcgtttttctgttacaatactttcgtgcccaaaagcacaaaaggattaaagtttgatggggtgttgttttgaaacaagaaaaaaggctgacgttcatctcagccatcagtttatttgtcttgatgttagcagtcattatttcctgcctgtttttctttcatacggaaccgcatatgccactgtttttttgcgtcattattctggctctggcaggtttgtggctcggtttctcgtgggacagtcttgaaaaaggaattgtcaacggtttgaaaaacggagtacagccgattatcgtgctggctttgatcggtgtgctgatcggcgcctggatgtacagcggtgccattcccgccgtcaccgtttacgctttatcgattatacagccgagccagcttcttttgaccgcattattttcctgcatgatcatcagcacgcttgtcggctcaagtctgacaactgtcagtacaatcggcgtcgcgctgttaggggtagcaagcgcggcgggtgttccgctcgaatggacggcgggagcagtcatttgcggggcttgtttcggtgataaaatgtcaccgatgtccgacacgacgaattttgccgccggaatcggcgaaattccgatttttaaacatatccgccatatgatgggcacgaccgttccggcactgctgattacaatcgttctcttttatattctcggttcatccgtttcaataaatgccgcttcaacgcaaaatattgaggcggtcatttccggaattaaacaggccgtacacgttacgccttggtcgcttctttcacctctgttggtaatcattctggcggtcagacgggtttccgttattccggtgcttaccgccgggattatttccgcagggattctgacggcttttttcattcctggcagcagcgttcaaggatttatttctgccctgcaaagcggcacggcatttaaaaccggcgatgaggctgtagccagcattatcaacagaggcgggctccaatccatgatgggttccgtctctctgatcatgattgcctttgcgctcggcggcctgatggaaaaaacaggactgatcgcagcgctgcttcaaggattgataaaaggtgtgcatacgaaaggacgtcttgtcttggcgaccgtcttctcaagcataggcgtaaatctcgcgacaggcgagcagtacttgtcaattttaattcctggtcagtcctataaacctttatatgacaggctcagcattaagcggattcaccttgcgcggtcgctggaggacggcggaacattgatcaatccgctgattccatggggagtaagcggcgcttttatggcaagcgcattaggggttcccgtcatcgactacctgccgtttacctttttcctgtacatttctccgatgatctcaatcctgcttggtttcctgaaaaaaaactgacaatccgaagacacctgccgtctttttcccggcaggttttttcatgcaaaaaatcccgctgaagaaacgggatttgtttaaaatgcctgctgaatgaacttatttctgataaacggtatttttaaaaagaaatgaataaacgaccgtctgatccccggctggctgagcacgctgttcatcagacggtagcggttttggtaaacggctaaaacagatacggcgcatagtgagtagatcaacaattttttcatcttatccctcctgcccctatcgtttgtcaaacagcgaaaattattccggtgcaagacgttttttatgcgattaagcgatgatttcagattcagtcacgatcgtatcgaccggaatatcgtggggcatgcggggaatgcggtccgtcagctggcagtcaaagagaagcgacacggtacggccggcatagccggtcaggaacctgtcataatatcctccgccgtatccgattctgaagccttcccggtcaaaagctacacctggcacaagtacaagatcaatgtctttttgggccactttttccgtcaggctttcgatcggttcactaaggccagcatatacggtttccagttgatcatccccagaaaatgtacggaactccattgcgcccgttttcgggaagcatttcgggatacagacttgttttccctctttccaagcttgttcaataatcggccgtgtcgggatttccaagcgtttcgagacggtaacggcgatcatgcgggcttgtttccattcctttaaagaaaacagcgtttcacgcatgctgcggcattttgcctcccattcactttctgttatagcagaaagctttgcttttatatcggttctgatttgtgctttcacgttcctcaaacctccctgaaagacaaaaaagccagaactttattgaaagctccagcttttttccgccgttttaaacagcttattttgtttcacggtgtaacgtagattttttatcacgtgggcaatattttttaaattcaacgcggtccggattgttgcgtttgttctttttagaaatatagttacgctcaccacattcagtgcaagccaaagtaatattaacgcgcattattttccctccaaactaaatatcatttacttattcagacttatatataataccactataatggacggaatgctagagctgatttacatgaaatgttgtttaagtgcagaaaacatcagtttatgcttctgatcgcctgaatgagcttgcgcaagacagatacaaaatatgacgaaacaggacaaaaaaggacattctcatgcgaaatctatagagaaatatccgtttgctccccgaataaacaagatttcccgacaaaattccgtttttttctctatttcctttagaatggcggcgttttatggtataaaaaagaagggcaaattaataatagaaggtgatgaaacgtggaaattgctattattgcgttgtttatcgtcagtatagcgcttattgcattctcatattctcaaagagatccgatgaaagacgtggaacaggagcttgaaacgcttcagctttccgccatgcaggaaatttacaagttaaaaaagaaaatgacggtgcttgaagaagaattgctggaaaccaacctcgtgatccgcaaagccaaaagcagcggcattaaccaaaaaatcgccaaacaaatcatttcaaaatataacaacgggatgtctgccgaagccatcgcaaaagcagagcacgtgtctgtcgaggacgtcaataccattattaaagataatgagaaggtgctcgtatgacaaaacggggcattcaggcttttgcagcaggcatgattttagcgacggccgtcctcgccgctgtcttttatttgactgaccatgaccaggcagctgccgttaaaactgaaaaaacagcattaacagaaaaagaagtaaacagctacctcgactcccagcaaaaagtctccgtcaaacgggatgactatcaaaaactgcttgactctaaagaaaaatcgctgagcaacgatcaaaactcagacgccaaaaagaaaaaggtaacatataaactgacgattaaagacggaatgagcactgctgatgtgtcatccattcttgaaaaagaagggattattccttcagcgaaggactttaatgattacgtaattgacgctggctaccacaaagaaatccgtgccggccatttcaaagtcgactcagatatgagctttaagaaaatcgtcaaaacattaacccgctaaaaaagcttgcaggcatcgtccattcagatggatacggccggcaggcttttttaatgagcaatataaaacggacccggtctatggccgggcccgtttttttatccgaattttccgctgatatagtcatgcgttttttggtgatccggctgtgaaaagatttttcccgtatcaccccactctaccagttcgcccatatagaaaaacgcggtttggtcagagacccttgcagcctgctgcatattgtgcgtcacaatgacaatcgtgtacttttctttcaaagtcaaaataagctcttctattttccgggtggacacggggtcgagggcagacgtcggttcatccatcagaaggacgtccggttttgtggcgagcgcccttgcgatgcacagccgctgctgctggccgcccgacagtgaaagcgcctgctggtgaagacgatccttcacttcatcccagagcgccgcggcctttaaagattcctcggcgatttcaagcagtttctttttatttttttcgccatgtattctcgggccgtagacgacattttcaaatatggactgcggaaacggattgcctttttgaaacaccataccgatctgttttcttaattctgccgcatccgtcttctccttcagcagattgcgtccgttatagatcatgtcacctgtcactttgacattcggagccatttgcagcattaagtttaatgttttaataaaagtggatttaccgcagccggacggaccgatgatggcagttactttccgctcctcaaatccgatcgtgatgtcttttaaagcttgatgagccccgtaccatacgttcatgccgtgaatatcaaataaattctgtgtgtgcaccgcttctttcacaacgctcacggtccttccccctatccgaactttccgttaatgtagtcatctgtcttttgctccttgggactcgtaaaaatctgttctgtctgcccgtattccactacttctccgtttaaaaagaatgccgtgcggtcagacaccctcagggcctgctgcatgttatgcgtaacgataataatagaataatctttcttcagttctgtcagcagcgtctcgattctggcgtttgaaatggggtccagagctgaggccggctcatctaaaagaagcacggcgggtttcatcgcaagcgtacgggcgatgcatagacgctgctgctggccgcctgataacgaaagagccgatgaatgaagccggtctttgacttcatcccaaagcgccgccttcgttaaactttcttctaccgcttcgtccaaaacggcttttctgcgttcacccgcatacttgagcgcatgtgtgatgttattgtaaatggatttcgggaacggattcggtttttgaaacaccataccgatctcccttctgagagacacgacattaatctcatctcccagaatattcagtccttcataaaggatgtccccctcgcttctcgcagaagggatggcatcattcattctgttaatctgtctcagaaatgttgattttccgcagccggacggaccgatcagagccgtcaccgcatgtttttcaatatccatgtttacatgtttaaccgcttgtttgtcaccgtaataaattgataaatcattcacttccaaaatcgaagactccggcgatcgctttgtctgttcggattgttccctgacgatgtgatctatcatgttttcgcctcttttcgattaatttgccgtaagctttttataaatggcagatccgagccatcttgcacaaaggttaaacaagagcaccgagatcaccagcactgccgagccgccgtttgcaatcgcttctgcatcgggaatgattccctgcgtattgacactccatatatgaaccgccagcgtttcagccggcctgaaaatgtttaaaggagaggcttccgaaaacgggttcaaatccgtaaagttcagccgcggcgttgtcagccccgctgtaaataacaatgccgccgcttctccgaatactcttcctgatgccaaaatggcgccggttaaaatcgaaggaatcgcactcggaatcagcacggttttgacggtataccatctcgatacgcctaaagcgagagaagcttctttcagctccttaggaactgcggtgagcgcgccttctgtcacccggaccattacgggaagattaaagaccgttaatgcgagcgcgcccccgataatcgtgtagccccatccggtcaggttcacaaacatcagcatgccgaacatcccgataacaatcgacggaagcgacgacagaacttcaatacacgttctgataaaatctgtgactttattttgcggcgcatattcagccataaagacgccgccccccacaccaagcggtatcgtgatcagcatggtgataaacagaatgtaaaaggagttaaaaagctgatcccgtatcccgccgccggacgcgatggcgctcgattttgacgtaagaaaatgcaaggtgatttcagagacgccgtgaatcagaatatacaaaaacaatcctgccaaaatcgccgcgatcacagcggcgcataaaccgaatacaccggtggccaatttatccgttattttccggttcattacactttcctcctagatgacaagtagcgtatgagcaatataaacagaaacgacataatgagaagaacaagccccatcgaccataacgtattattttcaatactgccgtatgtggtatggcccatgtttaaggtgataatcgtcgttaatgttcccgccgtatcaagcaagctttccggcagaagctttgtatttccgataaccatctgtacggcgagagcttctccgaacgctcttgccatcccgagcacgacagcggtcagcaatgtcggaaacgccgccgggatgagcaccttcctgattgtctgccatctcgtcgcaccaagcgcatatgaaccgtcgcgaaggtgtttcggaagtgacgcaagcgcatcagcggaaatcgacgtaatggtcggcagaatcataaccgatagcacgatcgttcccgccagaaggctgtgacccgttccgcttgatttaaaagagccaataaacggaaccaatactgtaagacctatgaatccataaacgacggacggaatgccgacaagcagctcaattaccggctgcagtacctttttcccccaagtcggcgcaatttccgtcataaacacagcacccgcgataccgaggggtgctgcgatcaaagcggaaagaaccgtgaccgcaaatgatccgaaaataaaaggcagcgcgccgaactcaggctttgcctgggttggattccaattcagacttgttaagaactcaatcgggcttacaccatttacaaaaaaagattgcagccccttaatgccgagaaagattgtgatcgccgctgatgccgcaatgataatcgccgcacagacagacacaatcactcttccgcggacttcatccaattgcctgttttgttttgagcttattaagcgttcgcttacagactctttttctctgtgatttatcatttgtttacactcctataaagaagaagaggcggggagcccgccctcccctcagctttgcttgccgtttgcgtcacgtgtgactttcatatcagagatcggaatgtagccctgatcttttacgatacttttctgaacatcatcactgttcaaatagtcaagaaatgtttttgccaggcctgacgcgtcacctttcgtataagagtgctcgtaagcccaaatcggatattcgcctgtgacgacatttttctcttccggtttgatgccgccgatcgataaaggcgttactttatcatcgtttatataagagaatgccagataaccgattgctcccggtgtttccgcaatgatttttttgactgtattggaggaatcctccgtgatgccctcagccggctctgctccgtcaagagcgtatttgacgaatgtagcgcgtgttcctgatgaatcaggacggttcacgagagtaatcttttgatctttcccgccaagctctttccagtttttgattttgcctgtaaagacgtctgccagctgttttttggttatatccttcacacccgcacccgggttaaccgcagctgccatcgctactaccgctacacggtgatcttttagggctttcgcatcaatgccttctttttcttcggcaaagacatctgagttgccgatttgcactgcgccttcagacacttgcgaaagacctgttcctgaacctcccgcttgtacctgcacatcagcatccggatgtttttccataaacttttccgccgctgccagtactaacggctgcatggctgatgaaccagaaatggttaaagaacctgatgcttttttatcctcacttgcagattggccgtccgtcttgccgctttcctttgcatttccgcatgctgcagcaacgatcataacagcagccatcagaagcgtaagcatccatttgttttttttcatttcctgaattccccctgcgtttaatgtgtaatttgtcctacacgtatagagtaaagggttcgtgtaaaatgcgtataaatcaaatgttaaggttttgtaaatccggatgtttttttgtataaaaaaaacgcccacaagttgtgagcgttttttctatcagttatttgtattgccgttttcagcgtctttctggattttatcttcgtttttctgcttcgtattattttcttcttgcttctttttcagctcgaagtatttgtctagtaccgcttccccaatgtcattggtgatagaatatctgtcattgtaattttcgtaagcccatggaactacgaccgaaatggcaacttcaggatgatctgcaggcgcataagctacaagtgttgtgttgtaagtagacgcgccggttcttgattttataggaccatcatagaaggcctgtgcggttcccgttttaccagcagggttataacttttattagcaaaatttgctcttgcagtaccttgagcgccttgcataacaagcttaaaaccttgctgaacacgtttaatttcactttccgtcatatcgaggcggttcattacttccgggttaaccgattcaacaacggctccgataccttttttagaatcaggctttcgtacttcttttacgatttgaggtttcatacgaaagcctccattggcaatggtcgatacatactgagccatttgaagcggtgtatatgtgtcaaattgtccgatcgcaaagtcaagcaggaaccctgactgtcttttagttcccacatatcctgtcgcttcattcggaagatcaatgcccgtttttacacctaaaccgaattcactgaagtaataacgaaatttatcgaatgcgctgtaatcaagcggcaatgaatgccccgatatatatttacccttaccaatcgcaatcgcagttttaaacatatatacgttagaggaacgctcaagagctgttaaatcatttatcggtcccatcacacttaccgactttttaggaggggaatctttaatattcaaaacttcgtccgtaaagatattcccgatttttatagcacctgtctgataaccagttaacagcgttgctccttttacagctgaacccatgttataagaagacgtcattgttcctagtgcataatcatcaattttatatttaccgtttacttgtttaatttgtttgcccgccattgtaagcacttctccgttgcgcgggtccatcattacgacaaatgccctgtcaagcagctgtgtacttggtcttgcctttgccgctcttaaatttttctcaataattttttcaacgtctttttgcaattcggtatctatggtgagcactaaatcgtcaccggctttaccttttgtaaccgtttcagtatctgtcacgtttccagaggagtcagttacgtttctcactttttctttttgtccctggagcagattttcatattgatactctaaataactttttccaaccctgtcattcctgctatagcctagcgacaaataatgttcaagaaggtttgaagggagcccttcattggaactcgagacactgccgagaactgattttaataatcctttatttggataagaccgttcccagtcagacgtcacgtcaacccccggcagttcatctaaatgttcgctgacgacggccatttctttagccgacacaccttcatttttgatgtattgaggagtcagtgagtagcctgaatccatctgccttttgatcgcaaggacctgcatatcttttgaagtgagttcgttcagctgtttgtccgtgatccgtttcagctgaagctggtataaatcatcgtcagacagctttttgtcctcagctttttgcttttcttttgccgtaatcagtttttttgcctcatcaggcctcgttaacatccaatagtcttttttgtcccgttcagtcacctttttggtgcttaccttaatcataccagacaatttttttgcgatttttaaacgctgcgcctgggtggttgaggctgaacgtgtatatgtaatcgcatttaatgctttattcgttacgatgggattaaggttccggtcgtatattttccctctcggaaccgccgtgctgacatcagactcctcttgcttgttggcggcgtttttatagtcatcaccctgaacgatctgcttgatgccaagctcgacgataatccacgtaaaaataagaaacgcggccaaaaacaaaaaattaagccggatcggcagtgattttttcttttctttgtttactgctattttctttttatttctcctcatgacatcaccttttcttatttacagaaagaaatgacaccctcttttcaggtgccatttttcattctaaaggttttttcgatatttttctacagataacccttttatctttctccttttataaaattcggttcagccgcccgtttttgtcggtcttcttccactgtttcatcagaagtttccgcatccagtttaatgtcttttataaagtaataaatcagcggatggccggctccgagcagcacgagcgccgtcggtattcccactttttccttcagcaatgtaacgatcaaaaggaagcacaggatggaaacgatccggcctgcatttaaaaacaattccctgagcacaatgtattcaattctggcctttctggcaagccgcgcccggcctatcacatcatatgtaagcgagacatacggcacaagcagaacgggatagccgatggcaataaacactccgtacataagaagcgtcgtgaagctcatatgaaaaattatgagaaacagggcgccgtacacaatcaatccgccgataagaatcgcctttttacgcgctctttttttgatgagccttgatgcaaaataataggcaaaaaaagaaaccgcagaattaacgaggccgaacgtcccgagcgccagttcactgtttgtcgcaatgaacacaaatacgctgattaaaaaaacaaaaatcccttctctcaagccttgaaaaaagtgcgcgttggtaatccggcgccaattcagattcgtgtggcgctcatcaaaaacttttttcagcataaaacggcctttcgactccctccgtttcagaaaaaagctcatgaccacggcgagagcaaataagccgagcgacaggctgaaaatgactgtataacccgtattgttttcaagtcttgaaatgacatacccggccacaatcggaccgatcattcccgccgatgaagacaagatgcctaaaaatccgttgaaaaaatctctcgtttcaggttccgttatttcgaaagtcagcacattaaaagccagccagtaaaagccgtaccccactccaagcacggcccctatcaaaacgagacgggaagccgcattttgcccggcaagcagcacacttaaataaaaagcagccaaaaagataaccccgaacctgagaataaacaccctgtcaatttttttagccagccgccccgccagcagaaaggtaaacggctgcatcgtcacgaccgataaattgtatatggccaaatcaataaattttcccgactgcttccacaaatacacgttgacaaatgtatttgacagcgcgatgcccaaagagtaaaggccgccaatcgtcaataacagcagcagccctttatttacttcgatgtcgccgataattttttttattttgctcatcattgactcccctttactacacattagtctgtctcactcaaactgagatatgtaaaaggaatcaaagtcaataaaaaaacaaggcctcccgcaggagaccttgtgatgatttaaatcaattattttgcttcgctgtaaagacgggcaacttcatcccaattcacaacattccagaaagctgaaatgtaatcaggacggcggttttggtagttcaggtagtaagcgtgctcccaaacgtcaagaccgaggataggcgttttgccttctgaaagcggtgaatcttggtttggcgtgcttgtaatttcaagtttgccgttgtttacaacaagccaagcccagccagaaccgaaacggccggcagctgctgcagcgaatttttctttaaattgatcgaagcttccgaatgtgcttttgatctcttcagcaagctcaccagtcggttcgcctccgccgttcggagataaaagagtccagaataaagagtggttcgcatgtccgccgccattgttgcggacagccgtgcggatatcctccggcactgcgtttaaatcagcaacaagctcatctacggatttctctgcaagcgctgatccttcgatcgctttgttcaggtttgtaacgtatgtgttatggtgcttcgtatggtgaatcgtcatcgtttccttatcgatatgcggttctaaagcatcataagcgtaaggcaattctggaagtttgtaagccataatttttttcctcctttaaatatatgtactgaaatgccgctatgcgcgaacttttctaatctcaatgtaacaaaagaaagcatggtaatcaatgaaaaagctcacaatccggcgattccagcagacatactacactttatccgttcacagccgaaattaaaccttctaaagcaccgtccacaagaagtatccgatcataaagagctgaatgactcctttggcgacgacgcttgttaaaaagccgattaaagagcccagccccacttttgcagcggatttaatatccttttgatgaacaaacacctcagcgcagacagcaccgataaacgggcctaaaataatgcctgccacgggaataacaaaaggcccgatcaataacccgatcgtgcttccccagatcgccgccctgctcccgccgtaccttttaatgccaagtaaatttgacacgtagtcagctgcgaataaaacggccgcaaataccgcctcaatgagccagaacaggtaggaatacgggctgaaggaaaacaaaaatccgtaaaggagaaaaccagccactataaaaataacgcttggaatcaccggatacaccagaccgataaaagcaacggcgaagaccgcgatgataatcacccaatacaaaacactcataacaaaaacaccctcctttgttttgcggagcgatcaccgcattccgcttttttcttattatgtatgattccttatcaccgctttaaatactctcgcttgtgttcatcccctgtgaacgatacaataagcaacatataccagtttaggctaggaagtgaagatgttgaacatatttacggctttatggaaaagtacatactctccggcagatattgcgaaaacacggtttcaagggataggaaaagcgatcctttatgtatttttgctgtctgtcctttttacgctgccgagcgcttattacctcagctccggcaccgtaaactcaatgaacggtttcaaaaccgtgttagaaaaagatttccctgatttcaaaatttcaaacggcgaattgcagacgaaagcctccgcctccaaggaaacggaagcgaacgggtttgtcatcgtgtttgatcccactgatgcttacggcgcgaaacaaatagcggcgaaacaaaacgcgatcggcattttaaaaaataaaatggtgcttgctgtagacggacaggcgacagaaatgaattattcattaatgcctgctgatatcacaaaaaaagaaatcatatcagctttaaaccaaaataaaacgatgatcgtcaccgtcctttccgttttgcttttcatcatgacggcagccggcaaattcattgaagtctcatttctcgccgtcatcggcctgatcataaaaaatgcgcaaagaaagacattgaattatcagcagctctggaagctttcggcttattccataacgctctccaccatattctttacgattatgcgcgcgcttgtcattacggtgccgagtgaatttttagtgaattggtttgtaaactttatcatccttttcctcgtcttaaaagagataccgccaagaaaaacagctgtgtaagactgcctgaggcagtcttcttttttgtcatgaacaaaatgggacaagcatacaatgaagtaaaaatgtatgcgggaggcggttggaatgaagcggcttacttttttattcggcagtttatttgtgatatttattatcttttacgatctgaaaatcgggacaatccctgctcaagaccttcctgcatacgcagcggcggcggctcagcctgcaaaacaggaagcatcatacagaacggttacggtcaaaaaaggtgatacggtgatgtcgatagtcggcgcacataaagcgccggaagatattgcgcaagattttgaaacgctgaatccgaatgtaaaagcaaacgccattcaggcaggcaccgcttataaattccccgtctatcgtaattaaacgttaatttcttgtcagttcggcaaatacactgttacaatataacatgtaaatagaagttgcctgacatgtaaaaggctctgcctcaaaagcggtaactacaattaaggagcgattgacaagtgagtgaaatcacacatcgtacaaaaacgcgtcccgtcaaagtgggacctttaacaataggcggaaataacgaagtcgtcattcagagtatgacgacgaccaaaacacacgacgtagaagcaacagtagcggaaatcaaccgattagccgaagccggctgccaaattgtccgggttgcatgccctgacgaacgtgcagctgacgcgattgccgacatcaaaaaaaggatttcgatccctctcgttgtcgatattcattttgattacaagcttgcattaaaagcaattgagggcggcgccgacaaaatcagaatcaacccgggaaacatcggccgacgcgaaaaagtggaagccgtcgtaaaagcggcgaaagaaaaaggaattccgatccggatcggcgtaaatgcaggatcattggaaaaacgcattttggaaaagtacggctatccgactgctgacggaatggttgagagcgcgcttcatcacattaaaatcctggaagatcttgacttccacgacatcattgtcagcatgaaagcgtctgatgtcaatctcgccatagaagcatacgaaaaagcgtcaaaagcatttgattatccgctccacctcggaattacagaatcaggcacgctgtttgccggaacggtaaaaagcgcggccggactcggagcgattttaagcaaaggaatcggaaacacgctccggatctctttgagcgctgacccggttgaagaagtaaaagtagccagagagctcctgaaatcgttcggtctcgcttcaaacgcggctacgcttatttcatgcccgacatgcggacggatcgaaattgatctcatcagcatcgcaaacgaggtggaagaatacatttcaaaagtaaaagcgccgattaaagtagccgttctcggatgcgccgttaacggaccaggcgaagcgagagaagccgatatcggtattgccggagcgcgcggcgaaggactgcttttccgcaaaggccaaatcgtccgcaaagtccctgaagaaacaatggtcgaagagctgaaaaaagaaatcgacaagctggcagaagaacactacgcaaagcttgaggcggaaaaagccaaagcagaacaagacacacaaaaagcttgacggatattccgccaagctttttgtgtgttttagaaaaacggtgtaatgaaaatgcccagcacaagggaaacaataccgattcccatcgcccatccgcctaaagcgcctgctcctcttcttctggcgatatagccgacgataatgccgcatgcccctaataaaacagggagcacaaacagggaaatgatagaaatagccaatgctgcataccctatcccccggccttcacttactccgtcccggttatcatcgcggtctgctgtccggtcagaagcgcgatatggctctgcaatttcagccgctgtttcttctgaataaacatcacgcgtgatatccgttccttccgatccatgatccacatagtagtcgttgccttttcgattttcgtaatcgtatgccaccttcaattccccctttttcttttatgaaaggagcttttttagtttccgcgttttttacggaatcatgtttgctaaactttgctggtattgttaattgtttatgttacacttgaagggatgaaaatataggagtgtggacatgttacggttaggtatagatattgacggcacggttacggcacaggatacatttgtcccttatttaaaccgctcatttcatctttccattactttggatgatatgactgattatgatctgactaagcttttgaacattacaaccgaggaattttgggaatggatgaatgttcatgaagcagtcatatataaagaagcaaagctcgcggaatttgccaagcaagcgctggacgggctgaaagaagaacatcgtctcatttacataacggcaagacgcggccacttagaagatgtaacgctggactggtttgcaaaccgggacattcattatgatcacattgagcttgtcggaggccatcacaaagtggaagctgtcaaaaaacacggcatcgatctgttttttgaagatcaccacggcaacgcgacaatgatcgcaaaagaagcgggcattccggtaatcctttttgattccccttacaatcagctccccatcgattccaatattatcagggtgcggaattggcttgaagccgtcgcctggatcaataaaaacaaacacagccttcagcatgtcaaaagctgaaaaaaacctcctgcttatgcaggaggttttttatcggcacgccggacaggtgccgtaaatttcaaatttatgaccgctgatgtcatacccttccaaattatcgtgaagcttatccatcggacaggactcaatttccttcgttttcccgcaggttaaacagataaaatggtgatggtggtgggtataagagcatgtaaaacggaacagtttttccccggaaagctccgttgtttccaaaatgccgagttcttcatataaagaaagatttctgtatatggtatcaaagctcagacccgggtagtcgtcatttaatgcggcaagcacgtttttggcggtcagatatttatcagaatcagcaaaaagctgcagcatgtcttctcgcttactcgtatatttataccctttttctttcagcaggttcaacgcttcttgtacgttcatgaggacctcccctttacatcacggtatcgctccaaaaagaaaatggcagctgtctgaacagcaggccattttcctatgctgtataaaattatacctataaaatgataaaaagtaaacgaaagcctagtgaatcgcggttttgaacttaccgcccctcgtttcatgtgtattcatgattgtaataaatgcgtttttatcaatttcaaacactatggatttcaattttgtcacttcaagccttgtcacgaccgcgtaaatgacttctttggattcatccgtatatccgccttttccctgaagcttggtggtcccccgtccaagccggtgcaaaatcgcgtctgaaatttccgcgtactggtctgcaacaataatgaccgctttcgtttcatcaagaccctggatgacggcgtcaatcgtcttcatggcaatataataagtcatgaaagaatacatcgcctgctccggcccgtatacaaaaccggcccaaataaaaataaacacattaatgagcataacgaattctccgactgaaaagggcagcttttttgtgagaaggataccgaggatttcagtaccgtccatcgagcctccgtttcggatgacaaggcctaccccgaaaccgagcaaaagccccccgaataccgtcgccaaaataggctgggtcgtaatggcctccacatgatgcaatgaggattcaatcagcgctaaaccgacgatcccgataaccgtagagatgagaaatgtttttccgatatatttatatccgaaaatcataaatggaatgttgagtaacacaacgaataaggcgaaattgaggatgggattggacataaagaggtggtctaaaattaatgaaacaccgataattcctccgtcgatcacattatttgggaccaaaaacaattcaatacttgcggcggctgagcccgctccgaccagaatcaagatgaccctgaagataaagtgtaaaaatgactctcttttatgctgtttatttggggtcataaaatctcctttcctttaataactattttaaacagtaagcaacttcattttaccattaaaagctgtaacattttaatgatttgctcaatacattatatttaaagaggtgaaagtatcgatgattttaatacaaagaattattttgcagcggctcaatcaagtcactccggacgatctgctgaaatattccaagcaatacggaatcagcattacgagaagtcaagcggctgaggtagcggctctgatgcacggtaaaaatatcaatatctttgatgaacaggagcggctgcgcctgctgaaaaaagtggaaacgataacctcaaaagaaacggcacggaaagttgacgaacttttcaatcaattctcagggtaaaaaaggaggggtgaattcccctccttcttcttattgagctaatattttttcaagaagctccttatcaaattgcttttctttcagcatttcgatttcaaaacggtatggcggcttcttatttttcttgtcttcgcccacatacggtgtttcaaggattttcggaatttcggccagctgctcatgatgaacaatgtactgcagcgcgttaaaaccgatctcaccgaacccgatattttcatgacggtctttccgggctcccctgatatttttactgtcgttcacatgaaggacttttatccggtcgatgccgacgattttatcaaactcattgagaacaccgtcaaaatcattggcaacatcatatcctgcatcatgcgtatggcaagtgtcaaagcagacggaaagatgttcattatgtgtaacgcccgcaatgatctcggcaagctcttcaaagcttcttccgcattctgacccttttcccgccattgtctccagcgcgatctgcacgctttgatccggatcaatcacttcgtttaatccttcaatgatttttttgatgcccgtttcagccccggcaccgacatgcgcccctggatgaagcacgatctgtttcgcgccgatcgctgccgttctttcaatttcagaacggagaaaatcaacgcccagctcaaacgttgccggattagtcgtatttccgatgttaatgatatatggcgcatgcacgacaatctcgtcgatgccgttttccttcatatgggcgcggcccgcttcaatattcaagtcttcaatttttttgcggcgcgtattttggggagcgcccgtatatatcataaatgtgttcgccccgtacgaaacggcttccttgcttgcggcaaggagcatatgttttccgctcattgagacgtgtgaacctattttcagcaacccgattccccctacttccctttgttagattggtttcttctctgttttcttctgattttttccatttcatagctcattttctttttatagcccggttttacttttttcggctttttcacaaggcgcttcgcaatttggtctgcctcattttccgtctttttacgtttcttgcggcggtggcggtcatcgccttttttccattctccgtttacaagctccgcataagcaaactcaatgcccatcttctcgagtcttacgagcgcatcttcgtcagaaagctcataaatggtcagtgcttggcctgatgagccggcgcgcgctgttcttcctacgcggtgaacataaaaatccagatcgtccggaagctcgtagttgatgacatggcttacgcctttaatgtcaattcctcttgccgcaaggtctgtcgcaatgacataagtgaactccagatcattaatctgcttcattacctttttacgctcacgcggcgttaatcccccgtgcagaaggccgattctcatgcctttttcagtcaggtatttcgcaatatggtcagcagtgtttttcgtatttgcaaacacaatgcccaaatacggattcagattagacatcatatcaaaaagcagcttgtctttatcacgctgtttagaaggaaccaaaacatgttcaatcttttcggctgtgattcttttcggctcaacatgcgcgtatttcggattttccatatactttttcaaaaacggcttcagcttttccggaatcgtagctgagaaaacaagcatctgaagttcttccggcatacgcgacccgatgtaatcaacgtcttccaaaaaccccaaatcaagcatcagatcagcttcgtcaatgacgagagactgcgctttatagacgttcaatgcctgcgccttaatcagatccgcaatccggcccggagttccgacgacgagatgaggctgtgttttcagcttatcaatcgatttttgcttgtccgttccgccgataaagcattttgtccggatctgctcgtcttctgcaccctgtgtgattttaagcgcttcctgataaatctgattggcaagctctctcgtcggcgctgtgataacagcctgtaccgtatcagaacccggatcaatccgattcaggataggcaataaataggcgtgggtttttcccgttcccgtttgggactgcccgatgacgctttcgtttttcaatacagcaggtatcagcctcttttgaatatctgtcggttcataaaaaccaaggcggtgaactgcatctataataaacggttttaagttgtatccatcaaatttagtttctttcatttttcccagctccttaaagcggcacattctgtgtccatcatcacattataaccgatttcacttaaaaacaccatgtcttgggggaatcctgttttcgagatagaaaagcaaatgccccctccgatgcatattgtaatagcagagagacagaaaggaggtacaagtatgtttccacagcagccgatgagaaatatggcgcagcagggccggccgttgatgaatccgcgtatgatgatgggaggcagaccgtcattgccgggccggcagctgatgcagcagggccggcagttattccctcagcagcagattgcaggagcaggcctgagaaacgcaggcacaggcggagggggcttaaaaggaatgctttcccgttttttacccggttcaggaggaagcgctgccgcgtccgctccgacagcggccagcggaggagcaggcgccggactgcagggattgcaggggattcagagtctggcaagtccggcatccctgtcgagcatgctcggcaacgtccagaaggtgctgggcgtggcgcagcaggttacgccgatgatccagcagtacggccctttagtacggaatctgcccgccatgatgaagctttacagtcagttaagcagcaacgatgatgagacagaagataaagatgagaataaatctgacgagacaaaagaaacagacgaacaagacaaaaaggatgaagctgaaaaaacagacgaaacagaagatgaaaacaaatcagacgcctcgtctaaaacgtcaaagaaaacgtctgaaaaagcatccgcttcaaaagaaaaagatgacgctgaagcaaaatcagaagaacggccgcgtccaaaaagaacatcgggcagatcaaaaccgaaattatatatttaacattctttgatatctcacgaaagattagctataatgagatcagaagaatgcaagatttaagccgtttaactacggctttttatattgcctctacactcacttttgataggaggacatctacattggacgttatcaaaatctcgccgcgcggctattgttacggcgttgttgatgccatggtcatagccaaaaacgcgtcactcgataaaacactgccaagacctatatatatactcggaatgatcgttcacaataagcatgtcacagatgcgtttgaagaagacggcatttacacgcttgacggcacaaaccgtctggagattttaaagcagattgaaaaaggaaccgttattttcacggctcacggagtatctccggaagtaagaaaagccgctgaggaaaaagggcttgttacgattgacgccacatgcccggacgtcacaaaaacacatgacttaatccgaaaagtaaaagcggaaggctatcacgtcatttatatcggcaaaaaaggccaccccgagcctgaaggagccgtcggcgtcgcccctgaaatcgtgcatctcgttgaaacagaggaagacgtgagaaacctcgatattcaggctgaaaaattaatcgttacaaaccaaacgacaatgtcccagtgggacgtccatgatattatggaatcagtcaaagaaaagtacccgcacgtggaatatcatcaggaaatctgtctggccacacaggttcgtcaagaagctgtatcagagcaggcaaaaaaagcggacttaaccattgttgtcggcgatccgaaaagcaataactccaacagactggctcaagtgtcagaagaaatcgccggaacaaaagcctatcgcatcggtgacatcagtgaactgaagctcgaatggctgaaagacgtcaataccgtcgccgttaccgcaggcgcgtcaacaccgacaccgattacaaaggaagtaatccgctttttagagcagttcgaccataacgatgagtctacatggcagcttgagcacaatgtgccgctcaaaaaaatccttccgaaagtaaaaataaaaaactgaggccgcggcctcagttttttttataagaaggcaaatggatttgtatctgtttcggaagcgaaaatacgcacgtcatagtttttctctccagccattgccgtaagcttctctgctgtgccttttctcatgatcttttcagcgtaatgcccgggatccacgacgtttaaccccatcatcatcgcgtcatgcgctacatgaaaataaaggtcgcccgtcacataaacatctgcacccttccgctttgcctgataaatgtatttatttccgtctccgccaagcaccgcgacttttttcaccttgctgtttcgctctccgaccatccggactccgttaacgtcaaacttctcttttacaaacagggcaaactcttcaagcgtcatgtcctgctgaagttttccgatgcggccaagccctttttcaagcggagactgctccaccggataaatatcatacgccacctcttcatacggatggctttttttcagcgcttttacgacggctttctccatacttgccggaaaaatggtctcaagtctcacttcatgaacgagttccaattctcccgtctgtccgataaacgggtccgctccgtccagaggcttaaagctgccgattccctcagaagaaaacgcgcaatggctgtaattgccgatatgtcccgctcctgcattgccaagtgcggttctgacagcttcttcatagtctttcgggacaaacacggcaagctttttcagcgggtccgaatatgtcgggacgagcacttccgtatctgtcaggccgagagcttccgcaagcagatcgttaactccgccgtccgccacatcaagattcgtatgagccgcatatacggcaatatcatgctttatacatttctcaatcagtcttccgccgggctgatcagtggtgatctgtttaagcggccgaaaaatcggcggatggtgagcgataattaagtcaacctttttctcaatagcttcatccaccgtttgttccagaacatccagcgtcaccatgacgtttttcaccggcttattcaatgtgccgatctgcagaccgattttgtctccttccaccgcaaaagccttcggtgaaaattgttcaaacagctggatgatttcctgtccgtttacatgtttaggcatgtccgattacctccttcagcagagagatccgctctttcagctcagctaatttttcttggttttcatgctttgcgctgcggctgatctgttcataaatttgttcagtatgcttaagttcctggctccatttccgaagaaacacttcattcttctcttttaacaaaaacggaccggcaagcattccggcagccatcgagatgtcccgataaggtgcatcacggtcgccggtttccgcgacgagtatttcataacactttccgtcttcttcaaggatcacttcatcaatcagttcatagccttcctgataaagccactctcttatatgaacggcatgaatattcggctgcagaatcagccgttcacgccccgtcagttttgtttttccggactccaaaatatgagcgatcagcgctccgcccatgcccgcaattgtaatggcgcccgcttctcccttttcaaggacgctcagcccgtcacctttccttacggagataagagtgcttaagtccagtttttccacctgctgtttggcggatagaaacggcccgtctgtaatttcaccggcaattgcgcggctcgctaaatgattcaaaacggcatagcaaggaagatacgcatggtctgacccgatatcagcaaccagggcacccggagggatatattccgctacagactgcaatcttttagataacttcatttcattcacaatatcacaacttttctcaggttctttttcctttactatcatataaaaaaaccgcccggaatccaagcggcggatagagtttttcatatgtcttttatatagggaccggtaaaattttatttaatcttagaaacccattttgccatgtcatccagcttttcggccggaacaaggcctgcaggcatcccgttgccgcccttttcaattcttgttttaatcgcagcgacatcttttcttttgccgacgccttttaagttcggccctgagacaccttcatagttttccccgtgacaggtgatgcagttcgctttataaatttcttcaggtgaagcgtttgcagtttccttttcggcatttttgctttcaccgccgcttgcgatctgatgcgcatctccatttcctttcactgacagaaagaaagtcagccctattcccagaactgcaatgagcaaaaaaggaatcagcggattccacttcatatctccatcccccttttttcattctccccctatgtaaacacttctaattctaacttatttttacaaaatgtaaatggtctcattaagccatttcactgatttcacaatttatacataaaacaaaaataactgttttgtttatccaaaattatctttattctattgtataatgaattgtatacgcttacaataaggaatataaataaacttatctcattatcccccttaaaaggacatgccgcatttttccgaactcatttgcaaaacaaatgcttatccagtaaaataaaggtatattatccatatatcttatacataaaaaagaacggatcaacagacccgttccattctattcgagaaaatccttcagacgtttgcttctgctcggatgtctcaatttgcgaagcgcttttgcttcaatttggcgaatacgctctctcgttactccaaacactttgccgacttcttccagcgttcttgtgcgtccgtcatccagaccgaaacggagacgcagcacgttttcttcacgatccgtcaacgtatccagcacgtcttccagctgttctttcaaaagctcatatgccgcatgatccgacggagacgtcgcttcctggtcttcgatgaaatcaccgagatgtgaatcgtcttcctcaccgatcggcgtttctaaagaaacaggctcttgggcaatttttaatatttcacggactttttcaggcgtaagatccatgtcttcagcaatctcttccggtgtcggctctctgcccagatcctgaagaagctgacgctgcacacggattaatttgttgatggtttccaccatgtgaacagggatacgaatcgttctcgcctggtcagcgatggcgcgtgtaatcgcctgtctgatccaccaagttgcatacgtactgaatttatatcctttacggtagtcaaacttttcgacggctttcatgagacccatgtttccttcttggattaagtctaagaaaagcatgccgcggccgacataccgtttagcaatgctgacaactaaacgaaggtttgcttcagccaatctgcgtttagattcctcgtcaccctcttcaattttttgagcgtaggtgatttcttctttagcagaaagaagatttacccgtccgatttccttgaggtacatgcggactggatcattgatctttacgccaggcggtacgctgaggtcattaaggtcaaattcttcttcggctttggcaagctgttgaatattaggatcttctgtttcttcattttcactaattaattcaacaccttgttctcctaaaaattcataatactcatccatttggtctgattcaatttcaaagctggacatgcgttcagcaatttcttcatatgttaaaacgccacgtttttttccagtttcagtcagctggtcttttacctgatccagtgtaagttctgtttctgtctcgtgggtttgtttatcagccattatggatccctccttccaaagcttgcaacgaattctaaaagcggtatgtttcttatccgtcccgggagctttctttctttttcagcatgcagggcagcagataataaatgacaattcatgatgaggttaagcgatctatttgctcctccgcaaggaatcattgccaatgagaacgcgagcctcttttttgatgttattttaatgatcggttcaatgcgacaatttcttgagccagagacgcagctttcacaaagtctttctgccgctctgcatccgctctttctgcttctttttcctttatcattgaccattttcggtgatccaacactttttttacgtaatcggataactcggcctctgagagctcctcgttcacttggagcatccctatatctgaaagcagctggctgatttcctcatcctgcattctcgccataagatgctgcggcgtcatttcagcgccctcttcataaacagcgtacagatatgctgccagcgcacgatgtccgtcaatgttaaattcaaagccgacacgttcaatcactttcttgatgacgtttctgtctctcagcatatgagcgagaagaagcctttccgcattctcataggcgggacggagacggcgccgtttcgcttttgtcgtcacccgggcccgtcttgtctgcggttcggcgtttttgtcgccgggggcgttttgtctggcatagatggaaagctgttcggtcagagattctaccgaaagagaaaattcggaggcgagctgcttcacatacatttcctgctcaagcgacccggaaagtgcgctgatttctttcagcacttctttcatgtaagcaagccggtctccttcatcagataagtttttccctttgcggaaatattgcattttaaaggccatgaccgtaacgcttgcatcaatgatatcggtcttgaatttttctccgccccgggttctgatataatcatcagggtcaagcccgtcaggcatcatgcatactcttaccttacaatcagctttctgcagcaggccggccgctttcagcgtagcctcatacccggctttatccgaatcgtagcagagaatgacctcctgaacatttcttctgaggattttcacatgctcttcggtgagcgacgtccccatggtggcgatgctttcttttacgcctgagctgacggcggatatgacatccgcgaagccttcaaacagaacggctctctcctctttcctgatcggcaggcgcgccttatggaagttatacagcagcttagatttatgaaacagcggcgtttccggactgttcatatatttcggctgctggcttccgagcgccctccctgaaaaagccgccacggctccgtgatgatcatgaatgggaaacataattctgtttctgaaacggtcaaaatacccgctgccgtcttcccttctgatcaacagacccgctttttccatctgttcttcctcaaaaccgcgctttttcaagaacttcgtcatgaaatcccaagaatccagcgcgtagccgatttcaaactcatctatgagctctttcgtaaaaccccttgataaaaggtaatctaacgcttcctggccttcctttgtattcattagcaaatgatggtaaaatttcttcaggagctcgtgagcttccgccatcttgtgctctccggaagattccggcctggatgcagagtgaatcgttatatcatcagggaaatcaatctgatatttatccgcaaggtgagaaacagcttccgtaaatgaatagccttccatctgccgtaaaaaagagaaaacgttcccgcccgctccgcacccgaagcaatgaaagatctgcttatcgctggagacggaaaacgagggcgtgttttcaccgtgaaacgggcagagcccaaagtagttgcggccttgctttttcaattggacataatcacctatgacttcaacaatgtctgctgactgctgcacctgattaactacttcatctggtatgcggtttcccatcttataacactccgtcgtacattattcgatgttttgatttgaaatcccttcatcattcgacaggatttttttaagcagggtaacaaatcgattccgatcttctttatttaattttttaggtcctttggaatggatgccgcttcttctcattttgcccgacatatgacggctcatcagagcgaagtcaatcgtgtcttcggtataagaacggcccctttccgataagacggcaatatttctgttcagcaaaagggatgccaaaccgatatcctgcgtgactacgatgtctcccgatctcacatggtttgcgatatataaatctgccgcttctttatgaggatcaacgtatatccagttctcgtttttgcttctggaaagctggtagtgttcaaatgatgcgacgaaaataacccgaacgctgaattgcgatgcaatgagcaatatttcctcttttacggggcatgcgtctgcatcgacaaaaatcgtcttttctttttcatttagaagactaattctccatccctccatcaatctcctgcataaaaacaagcgaaatcgcatatgctccatgactgcggatctatttttgtctttgtcgaaaaatttccgggagttattcttgacatcttactcgtaatagtttattcgtatcacactaagcttaaacctaaaaataaacattttatcacaattttttattataatacaaacttcgcgaagatgccatcctttttgtttattccctatttgcatacccaaaaacccaggataaagcgtcctgagttatcggccctttgtttttagatgatgaatgatgttcgctgtttcctcgaccgctttattcgaaacatcaacgacttggcagccgatccgggccacgattttctcgaaatactccagctcttctttaattctgttgatgttggcgtaaatggctttgtcgtttaagccgagagattttaaccgttcttttcgaatatggttcagtttatcaggactgatttttaaaccgatgcattttttcggatcaacgctgaacagttcttccggcggatcgacttcaggaacgatcggcacgttggccactttcagacgcttatgggcaagatattgagataatggggttttagacgttctggatactccgagcaggatgatatcggcttttaaaatgcctcttgggtccctgccatcgtcatatttgacggcaaactcgatcgcctcgacctttttgaaataatcttcatcaagctggcggacgcggcccggttcatatttcgccgtcagaccgtaggccgtttccattttatcgatgagcggaccgataatatcgtaatacagcacattcgctttttccgcttgttcaactaagtatttgcggatttcaggaacaacgagcgtaaaacaaataatgccgccgtccgctttggcgagagacacgacttcattgatggtgccgatatcttccacgtaaggtattcttctgatatgcgtatcatcggctgagccgttaaactggctgagcgaggcttttacaacgagttcggcggtttctccgactgagtctgatactacgtaaatgatgcgattgtccatgttatccccccgttagttttcaagcttatatgatttcattttctgataaactgacaagtatcttggtcatattcgttttcgtaaaccggccgatgacctcaaagcctttatccgtatctttaataacgggcagggcatcgatctgtttttcaattaaaaacttggcgatgtccatcacataatcgtcacgccggcagacggcgatattcggcattcttgtcataataatatgaaccggtattgaggcaagttcctgctggccgatgctcgcccgcagcaaatctttgcgtgacagcacaccgactaagacagcatcacgatctacgacaaataacgtgccgacatcttctaaaaacatggtgcagatggcatcgtataccgagacattttcattgatgacgacaggaatggattgaaaatctttcacttgcagctttttcagtttatcggcaagcagctgatttcccgttttccccgtataaaaataaccgacccgcggacgggcctctaagaagcctgacatggtgagtatggccaagtccggccgcagtgtggctctcgttaaattgagctgttctgcaatatgctctccggtaatcgggccgttttcctttacaatttgtaaaatttgttcttgccgtttatttaattcgatcgtactcaccacctttatggaagggtttatttatctatgtttttcattctgtgatgttatgtaaaaggggaaaagacgattgccgatcacacagcaaccgtctttttctttattttacaataagatgattcatattagcaaaagacttgatcacatctgcaagagcggtcatttgcgctaaacggttggtttttaatgcttcattgtccgcatttaccatcgtatgattaaagtaatcttcgatcggctcctttaatccgctgagcgcggtaagcgcctgttcatagtttttggaggcaaagctttccgcgacgctgtcttttgtcttttgataagcgtcaaacagctttttctcctgttcattttcaaacagatccggcttgatatcgcggctctcgccttttttgctgatggagatgacccgtcccagtgcctcagcggtttctttaaagcccggtgtgccgaggtgtttctcaagcactcttgccttatgaacagctgcatacggctcaaggtcagtgctgtccagaacggcttcaataacgtcatgacggatgtcttcagcattcaagacgtatttcagacgctgtgtaaagaaatcgaggagctcattttctttttccgtttctgtcaatgacagcagctctttaaaagaaatgccccagttgcggtcgatcagaatggaaacgatgccgcttgcctgacggcgcaaaccgtacggatcctgagaacctgtcggaatcacgtcgatgctgaagaaggaggcaatcgtgtccagtttatcagctaacgccacaaccgcgccggtaaaggttgaaggcacgtctcccccggccgctctcggcatatagtgctcatttaccgcggcagcgacggcttcatcttcgccgagcatgcgcgcatatttttctcccatgacgccttgaagctcagggaactcataaatcatgtgtgtaaccaggtcaaatttagaaatctcggcggcgcgcttgacaagtttttgcgtctgttcatcagccttcaggcggacggcaagtttgcccgcaatggcggccgctcttctcactttatctccaagggagccaagctcttcatggaaaacgatattttccagtttcttcacgtttgcatcgatgttcagcttttggtcttctttgtagaagaacgcagcatctgaaagtctcgctctcagcaccttctcgtttccgcgggcaacattttcaattgcatggctgttcccgtttcttaccgtaataaaatgaggcagcagattcccgttttcatcttttaccgggaagtagcgctgatgctctttcattgttgtcacaagcacttcttcaggcaaagaaagaaactcggattcaaaagagccgtaaagcgctgtcggatattccacaagttgattgacttcgttaagcagatcctcatcaatcggaatattccatttcttatcggccgcaagcgcgtccagctggctttggatcatttgtttgcgtactttcggatcagcaatgacgtgctgttctttcagcagctcttcgtatgatgacggtgcgtcaatagatacttcttcaccgagaaagcggtgtccctgtgtgttccgtcccgtccctacatttgtgatctcaaacggaataacgtcttttccgaagagagctgcaatccatttgatcgggcggatatagcgcaggtcttgtgtgccccagcgcatgtttttagggaaatgcattccggtaatcaggttttccagctgcggtaaaagtgtcttcgtctcttgtccagcctggaatttttggacgaagacatattccgtgccgtttacgtcttttatatacaggtcatccactccggcaccttggcctttggaaaacccgatagcggctttggtccagttcccgtcagcatccagagcgatttttttcgccgggccttttgcttcttcctgaatatcagcctgtttttctgctacgtcttttatatatactgccagacgtctcggtgtattaaaaagtttcacttcgccgtgagcgatatttttttcagccagccagccagtcagcttttcaccgagctgcaccatgctgtcatgtaaaaaacgcgccggcatttcctcgagtccgatctctaaaagcaagtcttgtttactcatgggaagagccctcctctttaagcattgggaaccctaatttttcccgttcttcataatacgtttttgctacttttctcgctaagttgcggacacggccgatataacccgtccgctctgtcaccgagatcgcgccttttgcatcgagcagattaaatgtgtgagagcatttcagcacataatcataggccggatgcacaagcccgttatccatttgtctgatcgcttctttttcatacgtgctgaacaaatggaatagcatatccacatctgatgtttcaaaagtataaacggaatgttcatattcagccatcataaacaaatccttcactgtaaatcctgacgtccattcaagatcaaagacgttttctttatcctgaatataagacgcaagacgttcaatgccgtacgtgatctcaacagacaccggtttacattcaattccgcccacctgctggaagtacgtaaactgggtgatttccatcccgtcaagccatacttcccagccgagtcccgcacagcctaaagacgggttttcccagttgtcttctacgaaacgaatatcatgctcgagtgggttaatgccgagcgcgcgcaatgaatctaggtaaagctcttggatgttatcaggcgacggcttgataatgacttggaattggtgatgctgataaagcctgttcgggttttctccgtatcgcccatccgcaggccgtctggacggctcaacgtaagctactttccacggctccggcccgatgctccgtaaaaatgtatacgggctcattgtgcctgcgcctttctccacatcatacgcctgcatgagcacacagccttcactcgaccagtgcttctgcaaggttaaaatcatatcttgaatgttcatttcaagcacctccactttctccattcttttacaagtgcggcggcaatcaaaaaactcccgtctctatgcttgccagccgcaaacatagggacgagagttctcccgcggttccaccctagttgctgaggatgtgaatcactcagcctctttttaaagggttgctcaagaatgcctttcgttgcgcgctcatccttagcttacactgtcctaaggtcgcttatatgagttggacgcaagtacttctttctgtcactgcaacatattttataataaatgatcatataaaaagatgggcagaatgtcaacttttgttttcatccaaaaggtgcttcatgctttccatctggtctaaaaaccgtttagactttaaataaagccctgaatattcctcataatacagatcgataacccgtttaagttcgtttttggtttcctgttttaatgagacgctgccgagccttccgatatcaaagtaataaaaaagccttagcagccttgccgtttgcggcgaaatcggaactttgtacggatcctttccaaagcagcggtggcagataaaaccattatctcttaccgaaaaatgaaacgtcccgtcccggcttttgcagtggacacaatgattcagctccggatacagtcccatgacgccgagcattttcatctgaacgatgaaggtgatcacgtccgggtcagtcccttcattcagcctcttaaaggattcgagaatcaattcgaataaataggggttcggtttcttctcttccgttcctttgtcagtaagttcagcgataaaagcggcatatgccgtcaaaaacaagtcttctctgatcgttctcatgctgagaatcatttcaccctgctggagcgtgccgagtccggatgttctttgcattaaaaatgacccgtacaaaaacggctggctgactgctgacagccggctggctgacttcctggcgcctcttgccataacgccgattttgccgtgttccctcgtcagcaatgtcacgattttattcgtctctccgtagtcattcgtacggagcacgattccttcacattttgtcagcatttccgcaccttccaacaatgggaggggccaagaggtttacaaaattggaaaatcaattcgggctagctcatcttccggttcttcgggtctttccaggttctctttttccagttctttaaaaagaaggtacgtatcaacacttcctgtttgagaaaatacgttccaggtaaaattcaacacaaaaaacccacctttcatcattaaactagcttgccaatccaaattcttacccttatcttgacctgatgtcctccttttcatgttaaacaaattttgctaacgaatccctgtttctgtgaggtaatcccacacctcacgtatgggctgaaatcatttaatattcatcctctttgaaaccgaaatcacgcagctgagacattttattccgccagtccttctgcacttttacccatagttccaggtaaacgcgtgagcccagcagcgcttcaatatcagcccgcgctcttttgccgacttctttcagaagagctccttttttcccgatgacgattcctttttgagaatcccgctcgaccacaatggtggcggcgacatggatggagccgttttcctgtcctttaatggactcgatagcgacagcgatgctgtgcggcacttcttcccttgtaagatggagcaccttttctctgatcagttcagaaataataaaccgctctggatggtcagtcacctgatcactcggatagaactgaggcccttccggtaaatacgcttcaatctgtgcgagcagggtctcgacgttgtttccttccaaagctgagatcggcacgatttccttaaacggatagcgcgtacggtactcatcaattaaaagaaggagctgatcagggtggatcttatcaattttgtttacgatcagaaaaacgggcgtggacgtctgtccgagcttttcaatgataaactcgtcgccctttccgtacccttcttcggcgttgatcataaataacaccaagtcaacttctttcagcgtgttctgcgccactttcatcataaaatcgccaagcttgtgcttcggcttgtgaatacccggtgtatcaataaaaatggtctgcgatgtgcctgttgtcagcaccccttggactttatttcttgtcgtctggggtttgtcgctcatgatggcgatcttttgaccgatgaccctgtttaaaaaggtagactttcctacgttcggtcttccgatgatagatacaaatcctgatttaaagctttcgttcgtcatgtaaatcctccgatgaaaatgcgcccggcaataattcttccgcagtcatttcttttatttgtccttgtaagttggtcagaacaacaagcatatcctttgaacacagctcggaaatcacttgtctgcaggctccgcacggcgaaaccggtcccggagtgtccgcagccacggcgagcatcacaaattccgtatccccctcggaaacagctttgaatatcgccgtgcgttcggcacagttgcacatgctgtatgccgcattttcaatgttgcagcctctgtacacttttccgtctttggtaagaagagcggctcccactctgaagtttgaatacggcacatacgctgtgtcccgcgcttttaatgcttctgcaatcaattcttgtctgttcatgtgtacttattcctctcttacctttatcctgtatgataccgctgtcacttttattttacataattatgattggtttttcacgcccatttttggcaatgtaaaataattgtaagaatcttctgctaacatattttcggcaagaagatgagtaaaccaatgatacacgaaatcacggcaaagacgcaaacggctccggcggccgcgtcttttgccgcttttgcgagcggatgatactgatcggtaactaaatcaacaacatgctctatcgcggtatttacaagctccagagcaagcatcccgccgatcagcatcaaaacaacggcccattcggccgtgctgagcccggtgagaaaaccgcaaagaataacggcgcaggccgcgatgatatgaaattgaaaattacgctctgaccgcgccgttttccagattcccctccatgcatggacaaagcttttcaggaacctgctccactcgtttttatgatctcgtgagtccatactcatccagcaaatccttttgctttgaaaacatttcttcctcttcttcttttgtcatgtgatcatagccaagcaaatgcaaaaagccgtggacagccagaaaaccgagctctctcataaacgaatggccgtactcttcggcctgctctttcgttctgtctgcgctgatgataatatctcctaaaactggcggcatgtcggcgcccacgatttcaacctcgtcttcgccttcttcctcaagcgcaaacgaaattacgtcagtcggagtgtcttttccccggtagtctctgttgatttctctgatttcatcatttgtcacaatcgtaaccgatacttcagcctgatcctgaacgccttctttttccgccgcaaattggagcagcttctccacttcctggagcgcatcggctgaaacgctgtttgtttcatcaacaatatctatgagtaaacccatttatttcaccttcttcgtagcctccggatattcaatccgggagtggaaaattccttttaaagtcgcacatagtgtttttgcgatcgtatccagctctcggaatgtgagatcacattctgagaactgcccgtcctgaagcttgtcggatataatcccccgcaccagtttttcaatacgttcgggattgggattatgcatggaacggacggcggcttcgacactgtcggccactgagataatagccgcttcttttgattgcggcttcggtcccgggtagcggaactctttctctgtaatctggtcgcctttttctttcgctttataataaaagaattttaaaagggacgttccgtgatgctgctccgcgatatccacaagctctttcggaaacttgtagcttctgagcatattcgcaccgtctgtcgtatgtgcgatgatgatatttttgctgagctgaggagacagcttatcatgcggattatccatattcatctgattttcaataaaatattgcgggcgtttcgttttgccgagatcgtgataatacgctccgacccgtgctaaaagaccgttcgcccctacagcttcacaggccgcctccgacagatttgccaccatgacgctgtgatgatatgtacctggtgtttccgttaaaatcttgcgaagcaggggatggttcggattagacagttcaatcagcctcatcgttgaaagaatcccgaatcccgtctcaaaaaacggcatcaggccgataatcaaaacggatgaagcaagccccgagacgacccccatcagcatcagcgttccgatttcaacaggtgacagcgccgtattttgtattagcaaaagcgacagcacgataatcatattaataaatgatacaaacagtcccgcctgcaatatctttgatctcgcgttatgttttcccaaaaacagaatgcctgaaatgctgcttattaaatagtaaataccgatcacataattaaacgttcccgtcacgccttgattaaacatcatactgccgcaaatcgccaaaatgatgcttcctaaaatagcgagcctttcattaagcagcagcctgaataatatggcgccggcggcgatcggaactaaataaccgatattcgtgtattcgattttttgaaacaggctgacgacttccattatgacaagaatcagcgttgtaataatggaaaataacaaaagtgatttatttttcagcttaagttcctgctgctgtttctcaaaatagtagacaagcgtagcaatgaacagaccgatcatcagaaggagaccgctgatcggttttaacaggttggaattgttcaaaagtcccgttaattcgagctttctgtatacttcccgatcgatcaggtcattctcttcaacaagaacctgtccttgtttgatttgaaccggctggacactgtctgacgcttcctggcgctttgcatcagtcgctttcggatcaaatacgtaattcgggatgaccgcatattttccgatttcagttgccgctgacaaatactttgacggcacggaagcgcttttcagctcttttgcgactttttccttcgcttccgctaatttttcggacggtatctcactgctcatcaccgtatttaccgcagtaatgacggaatctcttacaaatgagaaatcttcattgttcgcatggagaagcgatgtaatagcatcttccgagatggattcattgacatcctgtgtcagcttgcttttcaccgcttttaccagcgatttttccgaaggtgactttttgtctttatccgcatcttgtttcacttcaccgatgctgtcaaaaatggaagtgatcaggtcaagccggttgtcggtatagccttttttcagagtgtactgatcttccaccgcatcttcggccgcctgttttttcgcttccgtcgcctgctggtcttccacggtggcgggcgcgtaaatcgtcttatcactgactgaaaacaaatccaaattaagtgattcaggttttacatgaataaagagcaaaccaaacatgatcgctgaaagcagcagatacagcagcacatgggctgagcgggcatgtctgaaactgcggaaccgttcccgggcgcctttaccctttcccttctttttcaaaacaagaacctcctccctgaaacatcaggaacacatcatataaaaatgacccgataacgggagatcgggtcattttgcattacttttgcttatcataagcttcaataatttttgcaacaagcggatgtctgaccacatctgtctggtcaagttcaatcacggaaatgccgtttatgtccttcagcatatccctcgctactgcaagtcccgatgtgacgcctttcggcaggtcaatttggcttacgtcgcccgtaatgatcattttagagccaaaacccaatctcgtcaaaaacattttcatttgagcgggggtggtattctgggcctcatcaagaatcacatacgcgtcgtcaagcgtccgccctctcatataggcgagcggggcgatttcgataacccctctttccataagacgttccgtatggtcgcttccgagcacatcatggagcgcgtcatacagcgggcgcaggtaaggatctactttttcctttaaatctccgggcagaaaaccgaggctctcgccggcttccacagcgggtcttgttaaaatgatttttttaatgtggccgttttttaaagcatgcaccgcttttacgaccgccaaatatgttttgccggttcccgccggcccgatgccgaacaccatgtcgtttttcttcatcgccgcgacatattctctctggccgagggttttgacacggatcggtttgccttttgccgttttcgttatttcttcttcatacatgctttcaaaatagtccagttcatctttctttgccattttcacggcatacagcacatcacgttccgaaatctcgatccccttgcgaattaaagtaaggagcgagcccaataatctgtcagcaatctcaaaagactcatcattgccggaaacgtaaatggtttcaccgcgtgtgatgatgcttacgcccagatccttctccatcaaatgtaaaaaggcgtcttggctgccgaacaaagaaagtgcttcgtccgggcttttcagtttgtgattcatcgcaagtaaatgttctgccattctttagtctccctgaacaataggtgtggtttgaacgatatcttctataacttggtagagaataatcaactttactttaccattctcaacggattggtgcaaaactttttcactttccacctctccgctgccgcttaatcgcttttctacgtcttgcctgcccattttgatgccggcctgaaccgcttcgtcttttttataagtccgcacggatgtttcgctttctcttatatgttcttggacgtaagaaacagggagctttaaccccagaaattgaaacgggtgcttttcttcctcggttttcggatgttttagcggctcttctttaaacccgaagccccaaaaaggtacgccccacgatccgaaagacagcttgtgcttcgtccttactttacccgtatatagcgtaaatgatgtttcaagaggcacggttacttcagacttgtaccatgtttctccgtaaatttccgctttggaggcgactttcttctgctgctcttcattaccgatcagacctgagacaaggagctggcctttgtcaacatgatcgttcacaaaagccatcggctgacccttttgcacgaacattcttttgatgaccgctttctttttggcaacgatatggcgggggctcaagtatttttcttttgtcggttcatttttttcgaccactttcatatgaagggctgtcccgttcaactccacaccgacccacgtaatattttcgatgccgtttgttaatgatttttgaattttctccggcgtcatcattaaaaattgcaaacggccttttttcacaccgatttcttcaaggtgcttcaccatctgatgctcagtttcgggcttggcccctttaatatcgatttcccaaatcatgttggacaaaaggaacaatataatgaaaaaaatcacaaatcccgcggtaaagcctatgtttaatttagatttgagaagcagaaagggcaggccctttctttttgtaaagcttgctttgcattcatggtttctgatgactcttctgaaagcatgtacatcctgaagctgaatcataagcattacacagtcttgcttttttttcaccgcaaagatggcgattccgtttcttgtacattcattaagcagccgttcaattccttttcctttgacttccatttggactttacccgaaaaaaatgacagccatttgtttttcacattatttccccccggctttatgaatcgacatatcgtacgtgatctatcgtgccttccaaaagaatttcctcaggaaggattgccttaatgaccaagttttttcctgatatgatacattgcccctgcttgagcatcagcctgacttcttcttcgctgaacagcaagaggcctctgtgattctctatgtagatatgaagtctgccgaccatcgtaatacgaggcagatccatcataacgtccgggggaatttccaatgctcttgtcagccacgcctttacacgattctttctttgccccataaaaaaagaaccccctttcatctcatatgtatgattagaaaaggggttctaacactttattttttacggatgctccgcatggtccggtgaggttttttcgcacggggcgggcctaaaatctcactgaatatgatgccttgcaccgcagtttctttctttattttgagggctggtttcttcagagtcgtatttcgttggcgtgcagatgtcagctgatgttcaagcccattgaacatctgctctgtctccgcaagacgcttttcagcttcccttctttttttctcaaaagggttctcttctggaacggcaggcatttcttccgcttccggcttgtgctctttatgcggctgtttgtgctcctgcttttttgcctgattctcgggacgtgtgcccggcggacgtttttcatctttgtttttcttgccgaatattgccgatataatgccgatgacggcggcaatgacgagcggatttgtcagaatctcgtgcatatagcggctccctccttaatagagaggttattgttggtcttcatcttgctggtcattcgtcagcttgccgatagaatccctcatgtccgtgtcagcgtcgatattttttatgttcatataatccatgacaccgatgttgccttcacgcaatgcttcagccatcgcaagcggaacttccgcttcggcttccacgactttcgcacgcatttcttctacgcgtgcgcgcatttcctgctcttgggcgacggccatggcgcggcgctcttccgctttggcctgcgcaatgtttttgtctgcttccgcctgatctgtctgaagaatcgctccgatgtttttgccgatatcaacgtcggcgatgtcaatcgagagaatttcaaatgcggtgcctgaatccagccctttgccaagaacggtctgtgaaatcatatcagggttttcaagcacttttttatgattattcgaggaaccgattgtcgagacaatcccttctccgacacgggcgacaaccgtctcttctcccgctcccccgacaagacggtcgatattggctcttaccgtgattctggcttttgcttttacttcaattccgtccatggcgacacccgcgataaacggtgtttcaataaccttcggatttacgctcatctgtacggcttccaatacgtcacgcccggccaggtcaatggctgcgcatcgctcgaatgacagctcaatattggcgcgctgtgccgcaatcagggcattgaccaccctgtcgacattacctccggccagatagtggctttcgagctgatttgttgtcgcagcaaggccggctttatgcgctttgattaacggattgacaacgcggcttggtataacgcggcgcagcctcatcccgaccaaagtgaaaatactgattctgactcctgctgcaagcgccgaaatccatagcatcaccggtacaaaggtgaagaatatggctaacacaataatggcagctgcaactaatgctaaaatcgccaaacttgacagttccatctaattcctcctcaaggttatcatctatatttctctcacgacaatgcgtgagccttccactttcactactttcacctgtctgtctttttcagtgaatgacccttccgaaacaacatccaagcgttcatcatcaataatgacggtgcctgacggtctgagggctgtagcggtaacgccgactttccccaatagctccgtccggttctgatttgagacataaccgctctctgtgcttgttgaatcagttaatatcaatttcttaaagaatttcattcgtttccccaacacccttgttaatatgataaaggctgtaatagacacagcaaaggcgatcaagagagaaaccgccattacagtaaagctgcccgcagcgagaaagaggcttgcgatgacgcccgcaatcccgataaggccgattatacccccgggcagaaaaatctctaaaaggataaacaccaagcccgcgcagaataagaatatactgtcatagccggcaaatccggctgcgatatggcctgcgaaaaacagcagcaaggctgtcagtccgacggcacccggtattccgaggcccggcgaaaacaattcaatggtcaaaccaagcaaagcaagcgttaataagacggggacaacaaacggattcgtcagccatctgcttaatttgccgacaaaaccctcttttgcatgatgaacatccgatttatcaaaaccgagctttgtatataaagcatcaaggtttgaaaccgtaccctccgaatatccgacttccttggctttttcagctgtcagtgtcagcagctttcccttaggggcgcccgcttcttttgcattgacggcggggtctgccatggccagggcatatttcgggtttcggttgtttttagccgctgcgtcctccatttctgcatgccacagcgattgggcctttttgtctgccgcgtttccttttccgtcgatgatggctgcggcacccatttttccgcccggcgccatataaatttcatctgcctgaagcgctatataagccccggcagaaagcgcccgtttattcacgtaagcggtaacaggaacatccgagccgccgatgatatctgcaatatccaaggctgattgaacggcgcctcccggtgtattgatgtcaaggataatgtgtgacgcaccggattccttcgcatctttgaaagaacgcgataaaaacgaggcgagcccctgttcgacatttttctcaaccgggatgacatacaccgatggatgatcagcttttgcgttcaactgaacccctaataaagataatacaaataagcccaatagagcaacagcaattccggttttttttcggaacaaggcaaatataccctccttcctgcttcattcttctttatatacgtaacaaatgtactttagtttcatttttttatgtataaaaaaagacatctctccaggaaagatgtctttttcttgtcaattaggataattgactgctgacaagtctgttaatcacactgccgtcagctttaccttttactttaggcataatagcactcatcactttgcccatgtccgctttggagctcgcaccgacttcagcgatggtttcatttacgattgtctgcagctcttcttcagaaagctgcttcggtaaataaacttctaaaatgtccagctctttttgaactttatctactaaatctaaacgattagcgtttgaaaattcatggagggagtctttacgttgcttaagttcacgagataggacagtaagttcctcatcctcggtcaaactgtctttcttaagcttaattgcttcgttttgaagtgaagctttcaccattcgaacgacagtcagtttgtctttctcacggcttttcatatacagcttcatatcttggttaagtcgctcaagaagactcataaatccaccctcttttagaatttgcgttttctagcagcttctgactttttcttgcgctttacgctaggtttttcataaaattcgcgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaaaaagatacacatataaacatgtactttgacattataatataagccatcagtcaggtcaactaagtgagttcacttttccggcatgaaacaggcggcttgtctatataatgacggaaaggggtgtttcgtttgctgatactgattcttttcactgcacttatcctgatttttttactcggaatgagcctgctcagacagggactgatcgcattaacgtattcaaaaattgagaagagcctgctcttgtttaccgaccacccgttgaaagcttttctcattagcatcgtattcacgggttttcttcagagcagctcagcctttatggtcattgttatcggctttgtcagtgcaggcgctttaccttttaaacggacgattccgatgattctcggcacgaatgtcggctccacatttacgacggaatttttggccataaaaatggatgtgctcatttgggttctttttatcggcggccttgtgttgattctcatccgtaaatacccgttcaggcagatcggcataagcttcctcggtctcggcatcatctttttttgcatcacatgcttcagccgtcttgccgttccgctgacagaaatgaaggcgggagcggaggtattgcgccatgtaaatgattcaagctggtccgctctttttatcggcatgatattgactgcaatcattcattcaagctccgtctgcatcggcattttaatgagctttatgaacgaagggatgatcggcattgatcaggcggtcagcgtcgttttgggatctaatatcgggacatgcgtcacggccgtcatggctgctgtttcaggcggctatgccgccagacagaccgccggcgctcacgttgtctttaatattctcggcgtactcctcgtgtttcccttcctgtccgtaacagcggattttacggagcggctgtctgacgatcccgcgcaaatgatcgcgcatttcagccttttgttcaatgttgtcaccgccttattgtttctgccgttcactcatttgttttaccggctgattgacaggctgatccctgcgaaaccgtaaaaaaaccgatgcgcgaaagcatcggttttttttatctgttatgaagacatgcgcatgttctgagtcatttcttcctcaacgacgcggacgaattgtccttcattgtacggatagccagctttttgaattttgactttgacaagtttaccgattaaatcttccgagcctttgaagacgactttcatgtaattgtccgtatagccgacgaacatgccgtcttcatcagactctttaaacgtctcctccggaatgatttccagaacctctccttcgtaatcagaggcatattctttggcaagctggtcagacaaggcaatcagcttgtgcacccgttcatttttcacattctcgtcaacctggtcttccattctggccgcaggtgttccggtgcgtttgctgtaagggaatacatgaagctcagaaaacttatgttctttaatgaaccggtatgtttccataaattcttcttctgtttcacccgggaaaccgacgataacatcagaagtaacggcaagacccggcagtgcttctttcagcttatttaaacggtcagcgaaaaattccatcgtatattttcgtctcatccgtttcagcacggtgtttgatcctgattgaatcgggatgtgaaggtggcggacgattttatcagacgcatccagcacttcaatcacttcatcagtgatttggcttgcttcaatagatgaaattctgatccgtttcagtccctctacacgtgtatccaactcacgaagaagcttggcgaaattataatctttcatatcttcgccgtagccgcccgtatgaatccccgtcagaacgatttctttataaccggcatccaccagctgctgcgcctgtttaatgacttcttcgggatcgcgggaacgaagcaggccgcgcgcccaagggataatgcagaacgtacagaagttgttgcagccctcttggattttcaatgacgctcttgtccggtcagtaaaagcgggaacatccagctcttcaaacacgcgtgctttcataatgttgccgacaccgttgatcggctggcgctcttccctgtactgctcaatgtagccgagcattttttcacgatcctgcgtgccgacgacgatgtcaacacccgggatggccataatttctgccggggatgtttgcgcatagcaccctgttacgcagattacgccgtcaggattttggcggatcgcccgtctgatgacttgacggctttttttatctcccgtgtttgttaccgtacatgtattaatgacatatacatctgctgtctgttcgaattcttttcgttcataacccgcatctttaaacagctgccagattgcttctgtttcataatgattgaccttgcagccaagggtatgaaaagcaacagttgccattactgatcacctcttaataactctgtatgataggaaactgcgcttaacgcgtaaagcggcgcagtttcagtccgtaaaattctcggtccgaggccgcataagacggcgcctttttctgaaagctgctgaacttcagactcagtcagaccgccttcagggccgaatacgattaaaagagacgaaccttgcggaaggcttttgagttccgcggcgaaagcgcccgtttctccctgctttgatgactcctcgtatgcaacgacacatttatcgacattctccgccatctcaagcagctgccggaatgtatgaacggttttcacttcgggaatttcattgcggtacgattgctccgccgcttccttcgcgattttcgcccatctctcccgctttttctttgcctttttgtcgtcaagcttaacgacggatcgggcgccttgaaaagggatgaacatacttgccccgagctcggtccctttttggataatccactcaagcttatcgcctttcggaaggccgctggcgatcctgatctttaacggcagttcacggttttcccccgtccattcagcgacgctgcatgatatatgatctttagaaacctctttgagcaggcataacgcttcatggccgtctttcgaacagcagataatccggcctcccgcactcattctcatgacgttggcaatatggtggacgtcttcccccgtgatgtgaaaatcggggctttcgtccatctcctgcttcgtgagctcgataaaatatcgttgcatacgctgtgacacctactaactgttattttttcgcgatgatgctgacccaatcttccatagacagaatttctatgatggtaaagccggctttttccaacgcttcttttacttcctgttttttctggccgataatgccagaagtaataaaatggcctccgtctttgagcaggtcgtacgcctgcgatgtaaagcggagaatcacttccgccaaaatattcgcgacaatgacatcgtgttcgcctgtgatgccgtctagcaaattgttctgtttcacttcagccgtatcgcttactttgttcaatttcacattcagacgcgcgctttcaacagcgaccgggtcaagatcatacgcatgaaccgattcagcctcaagcatggcggctgcaatgctcaaaattcctgaaccagtgccgacatcaatgacacggtctcctttttgaacgatacgctcaagcgcctgaatacacagaacggttgtcggatgcgttcccgtaccgaatgccatgcccgggtccatttcgataatcagttcatccgtatgcaccggtgtatatgtttcccaggtgggaacgatcgtgaacttttcagaaattttcacaggatggtaatactttttccaagctgtcgcccattcttcttcattaacttcagaaatggtgattttgtttctgcccaaatcaatatcgtacagcagcagattattaatcgtctctttaatgccgtcgaccgtttcgcccaggaaactgttgatcgggagatacgctttgactatgacaccctcatcggggtaatcattggggtcgagctggtagatttccccgtaaacattctcacgctctttcattaaatcaagcggatcttcgatgacaaccccgctcgcaccagcttcatgcaaaatatttgagatgggttcgaccgcttcatgtgttgtgtgaatgctgatttcggaccatttcaaaactaccaactcctatccaatcattactcgcctttaaatgcgcgttttactttgtcaaagaaactcatttcttgttcatccggcaggttaccgctcacttcagcaaactcgcggatgatgtctttttgtttatctgtcagatttgtcggtgtgacgacgcggacgacaatgtgctggtcgccttgtccgtagccccggacattctgcacgcctttgcctcttaatctgaattttgtgccggtttgtgtgccggcaggaattttcaatttcacttttccgtgaagtgtcggcacttccacttcgtctccgagtgccgcttgggcaaacgttaacggcatttcacagtaaatatcatctccgtcacgctcaaagaactcgtgggcgcgcacatggaatacgacaaacagatctcccggaggacctccgtttacacccggttcaccttgacccggaacgcgcagctgctgtccgtcatccacaccggcagggatcgtaacgttgatttttttccgttttttcactttgcccgtgccgccgcagtccgcacacttgtttttgatgatttttcctgttccttcacagtggtggcagactcttcggttaaccactttgccaaacggcgtgttctgttcgacattcagctggcctgaacctccgcaatgcgagcacgtttccggctttgttcccggctttgcgccagagcctttacatgtttcgcaattctcttcgcgcggaatttcaatgatcgtctcttttccgaaagccgcatcttcaaatgacagtgtcattgtatactgcagatcagcgccttgccgcggtgcattcggatcacggcgtctcgtgccgccgccgaaaatgcttgagaagatgtcatcgaaaccgaaaccgccgaagtctcccccgccgccgaatccgcctccgaagccctgattagggtcagtatggccgaattgatcatattgagcgcgtttttggtcgtctgagagcgcttcgtatgcttcttttacctctttgaatttttcatctgctccggattctttattgatatcaggatgatatttttttgaaagcttccgataggcttttttgatttcatcctttgaagcgctcttacttactccaagcacttcatagtaatcacgcttactcatctcgcttcactctcccgaatttctcacataaattagattgtatcattttgaattatgttttttcaattccttttatcccgggcaagaaaaaaagtcaaagccaagagatgcctgactttgactttctgtctgttgaatcagaatatgctgtgtgttcttccgctttctgcggaaagaacttattttttcgcttcgtcgtcttttacttcttcgtattccgcatcgacaacgttatcgtccgcttttttgccttcagcgtttgctccgccttcagcctgctgcgcttttgccgcttcttcataaagcttcatggaaagctcttgaacgattgtttgaagctcatcttttttcgctttgatctcttcaatttcgtttttctcgatagctgctttcagcgcgtctttcgcgtcgtttgcttttttcacttgctcttcgtccactttgccttccaggtcttttaatgttttttccgtttggaacacaagctggtcagcttcgttgcggacttcgatttcttcttttctcttcgcatcagcgtcagcgttttcttccgcttcttttaccatgcgttcgatttcgtcatctgaaagacctgaagaagatttgattgtaatgttttgttcttttcctgtgcctaagtctttcgctcttacgtttacgataccgtttttatcaatatcgaaagaaacttcgatttgcggtacgccgcgcggtgcaggcgggatatctgtaagctggaagcggccgagcgttttgttgtcggcagacatcgggcgctcaccttgaagcacgtgaatgtcaacagccgtttggttgtcagctgcagttgagaatacttgagacttgctcgtcggaattgtcgtattgcggtcgatcagtttcgtgaacacgccgcccattgtttcaataccaagagaaagcggtgtaacgtcaagaagtacaacgtcttttacgtctcctgtgatgacgcccccttggatcgcagcaccaagcgctacaacttcatcagggtttacgcctttatgcgcttctttacctgtttcttttttgatcgcttcctgtacggcaggaatacgtgtagatccgccaacaaggataactttgtcgatttcgcttgcagaaagatccgcatcttgaagagcctgacggacaggagccattgtgcgttcaacaagatgagcggaaagctcttcaaatttagcgcgggtcaatgtcagctcaaggtgaagaggacctgcttctcccgctgtgataaatggtaaagaaatttgcgtagatgatacgccggaaaggtcttttttcgctttctcagctgcatctttcaaacgctgaagcgccattttgtcttttgaaagatcaatgccgttttcttttttgaattctgctacgagatgatcgatgatgacttggtcaaagtcgtccccgccaagacggttgtcaccggcagttgaacggacttcaaacacgccgtcgccaagttcaagaacagatacgtcaaacgtaccgccgccaaggtcgtatacaagaatggtttggtcttcgtccgttttatcaagtccgtatgcaagcgctgctgcagtcggttcgttgataatacgctctacttcaagaccggcgattttaccggcatcttttgtcgcttgacgctctgcatcgttgaagtatgccggaaccgtgataacagcttttgaaactgtttcgcccaggtagctttcagcgtatgctttcagatgctgaaggataatagctgacacttcttgaggcgtgtagtcttttccttcgatttctactttatagtcagtacccatatggcgtttgacagacatgattgtgttagggtttgtgatggattggcgttttgccacttcccctacttggcgctcgccgtttttaaatgcaacgactgacggagtagtacggtttccttcagcgttggcgataactgtaggctcgccgccttcaagcactgccacacatgagtttgtcgtacccaagtcaattccgattactttactcactttgaattacctcctgctatgtagttattgattcacttttaccattgaaggacggataacgcgatccttcagtttgtagcctttttgcagttcttcgataacaatattgctgccgaagttttcatcttcgacctgcattacggcttggtgaaggttcggatcaaattcctgaccgacagcttcgatggcttcaacgccttcttttttaagagcgtccatcagctggcggcggaccatttccataccttgcagcaagctttttgtctgctcgctttcagcttctacttgtaaagcccgctcaaagttgtcgagagccggaaggatttccgttacgacgttttgagaacggtatttctgagcagcttccatttcaaggcggctgcgtcgtttatagttttcaaagtctgcttgaacacgcaaaagcttgttttctttttcatcaagcaaaccctgcaattcatcaatttggtgctgaagatcttcttcctgaccagcggtttcttcatgctgttcttctgaagcggcttgttctgtcatttcttcttgttcagctgcttcaacctgttctgcggtttgtttttcttctgacattgtcttcacctccctcaaatgctgtaaaaagatgactgaaaatgattgccaaaattcccttattcatcatacaaacttgtgaatgcttttgacaagtccgaagtcacgtgctgcagcaggctgacgactcttgaataattcatgcgtgtcggcccgatgatggcgattgatccgatctgcttcgtatcaacagtataggtggccgtgattaagctgcagttttccatttcttcgtagtcattttctttcccgattttgattgaaatcccggcttttgatgactgaaacagcttcagaacatcctgctctttttcaattaaggataagagcgagcggacccgttcaatatcgtggaactccggctgattcagcatattgatttttccgccgaaaaacaatttctcaacatgggtcgccggatggaatgtggatcggagcgattcgagaatgctgtcatagttggcaatatgctgccttaaatatgtgacaacctctttaaaaatacgctcattcagttcgtccatcggcacgcccgctaatcgatcgttcaatatattgaccagtttttcaatatcggacaaatccactttagccgggaaattgatggtgcggttctcgacatgccccgtattcgtgacgaggatggcgaccgccttatccggctggatcggaacgatttgaatctgtttaagataattctcgctcagcgtcggcccgaggacaatcgatgtgtagtttgtcagttcggacagtatctgcgctgatttttggactgttttttcaagctcgaagattttttctttaaatatcgagtgaattaaatccagatcggtttttgtcagcttgacgggcgacagcaaatggtcgacataatacctgtaccctttttccgacggaatccgtcctgaggatgaatgggttttttcaataaagcccaaatcctccaagtcagccatctcgtttctgatcgttgcagagctgaatgtaatctcgtctttttttgaaagagttcttgatcctacaggctgcgctgattgtataaaatcattaataatcacttgcaggatcagcagctgacgatttgttaacatcatcatcacccctgttagcactctaggtcagcgagtgctaattctatatcaaaagtaacaaaccaaaagaaaaatgtcaattataactcacccaaaaaagcgccaaaaacctcatttcctaataatttgccctcatgcgtcagcgcaaccgatttttccgtgtcacaaatcaagcccttatcagctaaatttttgagaacatccggaaacagttcatcgactgagcgtccgaatttatcgagaaaagctttcttttgcacgcctgacatttttctgaggccgaggaacatttcttcctcaatctgttcctcccgtgtcacctcgtgcgtgtcccggtaaggcagccctttttcttcgatgagctgcatgtaatgtttcacaggaccggcgttgacggtgcgggtgccactgatatatccgtgagcccctgcgccgaaaccgaaatactcttcattgctccaatacgtcagattatgctgcgactcgtatccaggctttgcaaagttgctgatttcatattggcggatgcttgcttcactcatctgtctcatgaccgtttcatacatctcagcttctttttcctgcgccggaagatgcagtcggcctttttgcattaaattataaaataccgttttcggctctacgatcagcgagtaaacagaatagtgctccgcatcaagcgacaaagccgttttgacggaattgtcaaggtcatcaagcgtctgattcggcaggccgaacattaaatcgagactgatgttgtcgaagccgagggctctcgcccgttcaaaggaagtgaatacgtccttttgtttatgcactctgccgattttttgcaaaagcgcgtcttcaaaggtttgaacaccgaagctcagccgattgacaccggcgtttttcaagattcttaatttttccgaggataaatcatccggatttgcttccacagcaaattctatgagtccgtctgaaggcttcagcacgcggtgaacggaatccatcagtttatccagctggacgggtgagagcgatgtcggcgttcctcccccgataaaaatcgtgcggagatcaggtcggcccgtccgttctatagtatttatcatttccttttcgagtgagtttaagtactcgtcgacaggctggctctgaataaaatatttattgaaatcgcaatagtggcagatgtgctcacaaaacggaatatgaatataagctgatttcatttgaaacaccttcttctttacagaaagaagccgcagtgcgggactgcggcggcttccgttattttttcgggctgtcgtccattttaaggacggccataaacgcttcctgcggcacttcgactgagccgacctgcttcatccggcgttttccttctttttgtttttcaagaagcttccgtttccgcgagatgtctcctccgtaacattttgcaagaacgtttttccgcatggccttaatggttgaacgcgccacgattttctgtccgatcgctgcctgcaccggcacttcgaattgctggcgagggatcagttcttttaatttttcgacgatgacttttccgcgctcgtatgcataatcacggtgcacgataaatgacagcgcatctattttttctgcattcagcataatgtccatcttgacaagtttggacggcttgtagccgatcagctcgtaatcgaaagaagcgtaccctttcgtgctggatttcagctgatcaaaaaattcataaacaatttccgcaagaggcatctcatatacaatgctgacccggttggcgtctaagtactgcatgtcgataaagttgccccgttttccctgacaaagctccataaccgctccgacataatcgttcggcaccatcatagtcgctttgacataaggctcttccacccgctctattttttgcgggtcaggcatgtttgacgggttatcgacgatgatcttttcgccgtccgtcatataaacgtcataaataacgctcggcgcggtcgtaatgagatcaattttaaattcccgttcaatccgctcttgaatgatttccatgtgaagcattcctaaaaagccgcagcggaagccgaaaccgagtgcttgtgacgtctccgcctcgtattgaagggatgagtcgttcaattcgagtttttcaagagcctcgcgcaaatcattatatttagctgtgtcgatcggataaagtccgcagtacaccatcggattgagtttgcggtagcccggaagcgcttctgccgcaggcttaaccgcgcttgtgatcgtatcaccgacacgggtgtcgccgacgtttttaatggcggctgtcaaatagcctacatcaccgactgtcaattcgtcagccggctgcgctttcggcgtgaagacgcctacttcgatgacttcaaactcttttccggtcgccatcattttaattttctggcccggttttaccgttccttccacgactctgatatacgcgacgactcctcggtacgcgtcataaagcgagtcaaagatgagcgctttcagcggagcttccggatctcccgcgggagccggcactttttctacgatctgctctaaaatgtcttcgatgccgatgcccgctttcgctgaagcgaggacggcttctgaagcgtcaaggccgataacgtcctcaacctcttgacgcacacgttctggctctgcgctcggaagatcgattttattaatgacaggaagaatctcaaggtcattatcaagcgccagatagacgttcgccaatgtctgcgcttcaattccctgagccgcatcaacaacgagaatcgcgccttcgcaggcagccaggcttcgcgatacttcatatgtaaagtcgacgtgtccgggcgtgtcgatgagatggaatatatattcttctccgtcttttgctttgtatttcagctgaacggaatttaatttgatggtaattccccgttcgcgttcaaggtccattgaatcaagcaattgttccttcatttcccgctgggtgatcgccgatgttttttctaaaatccgatccgccaaggtcgatttgccgtggtctatatgggcgatgatggagaaattccggattcttgactgcctctctaaacgcttttctttatctgtcacaatctatcactcctactattaaacgcaaaatacactagcttagattatatcaataggattgtaaacattcaattaaaacaagaaagagaaaagcttcctttaaggaatcatccgcttttctcttcatcaatgctatcggttcagtttcaaaacccacttatacatcgcctgcgccgagtccgtcacggtatttgaaagggtttctccggcttttgaaaacaggttgaaggtttccgcctgttccagctgtttttgtttttcttccaaatctttcgccgtaacggtttggcccaaaatggaagcttctttctcctgcccctctccgccgccaagcgtgaacgctccttttaatgaggggtctttgtatcctttcatatcaagcattccgctgtttgcctgctgcatgccgaacaaaacgccgacaaacatgacaatggcgatcagcaggcatttgccggtaaaacggatcattcgaatcacctgatttctattgttttttcttctctcctgattgcgagctgactttttcggcgtcccagtacagttcgctgaatacatcggccatagcgtctgatgcgcgtctcagttcttctaggttgttatccacgcccccgaattccagcagaagcgatctgtcgtttaaatcctggttgtatactccattatctcccggagagccttttgataaaacaccgacgcttaagccggggtattttttctccatcagcttatgaagttcacttgcgagtttatagttttcttcaaaattggcgcttttttttccgacgacgatggcgactctggcatagctttttcctttaatatcggctgtcgtatttttcttgcggcgggaatcccggtgaatatctatggtatattgcaggtttttatttttcgcgagcgcgctttttacgacaggtcttgattcgtcatagcttcgcgcataatttaaaccgtctttgttcaagcgggcctgtatgtcggttttatctacggtcgctcctacgccttgggcttcaagcgcttttccgaacatatctccgacaagcgtgacattggcctttgaatggcgggcattatcaggatttgtttccccttttaacagagggagataggattcggtattgtgagtgtgataaataaagacgactttcttgctgccggtcgaatgttcgggcggcgccgtttcttcttttttcgttttgttttcgatttctgccaggttcacttctttttctttttccatcacctttgacggcggcggagattcagccggcatattcgtataatccgtcccctgccccgccaaaaggatttccgtatcgtattgggcaaatcccggaagctcacgtcccaagaagctccgcgggtcttccagattaatgcttgtcgccagttttaaggaaagccgggatagctgaaatgaatctttttcgggaagttctgacgcgaaataatgattctccatgccaaggaggtgtgcaaacgcgtcacccggaagttctccggcaattccgtgaagagaatcggaagaaagcctcaattcaggacgaagcgatgtaagcacaccggataatacgaaaataacgataaggcttgtcataaacaaaaacatgcccttgagcgcgtttccaccgtttactgcaacgacaatttgacggtttctgcgtttttttctcatgatttgaatccctccagcgcttgtctagtaattactctatgaacaagctagaggaggtagaaccaatttagtgattatacgaacctttattatcttgtgagaccttttcatgaagggcggtgtttaacccgtttgcaagcacgttcgccatatcatcaataaaggtgtcaatctccttcggcgtaaccatcagattatggccgagcggagaaagcacttcatgaatcagctggcgcttttcgttttcgtcaagcgtgccgacaatgccgagaaaggattggcgttccttttccccgggaagatcctcatctgtaagcaccttctttttgccgaagttcattccggcgggcaccagagaccttgacggactgtcatctttcatctctctgccgaaatgctttaatatgtagtccactgtatcgcttgcgatcgttaccgcatcaacgacagtcggtacaccgattgcgatgacggggatgccgagcgtttccttgcttaattcttttctcttattgccgacgcctgatcccggatgaatgcctgtatcagaaaattgaatggtcgtgttcactctttcaacggctcttgccgcaagagcgtctacagcaatcacgaaatccggctttgattctttgatcacaccttgaataatatcgctcgtttcaattcccgttaagcccatcacaccgggggcaagcgcgctgactggcctgtacccttcctgcacattttccggctgaagcctgaacaaatgcctcgtcacaagaaggttttcggttacgagagggccgagcgcatccggcgtcacattccagttgccgagaccgacgatcaaacagcttgcatcctttggaatctttaaagccgacagataggcggaaaattcctcggcaaacacttccgttactttttcctgcatttcagagtcgtgctcccggaccccttgcgcttcgatcgtgacatagcgcccctgctttttgcccgatagctctgcgccttcttttgtaatatctacggttctgactttaatgccgcctttgtcgcgttctttttcaataaacccgtttatttcttttttctgatcagtttgtccgtcttttaccgcctgttttgtttctaccgctaaatccgtccgtatcagaaattgattgacatccagttcgttgtttttcacaaggtagacctccttcaatcatcgtggtacatagtgttgccatttgcaaaacgaatcatgcgaatttacccatcaacgaaaaatactttacatttatattgcaatctaaagttctgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgctcataacgcgacaatcaaatctgctatgcgtactgcaatcaaacaagtagaagcttctgttgctaacaacgaagccgataaagcgaaaactgctctttctgaagcagcgaaacgtattgataaagcagtgaaaacaggtcttgtacacaaaaatgccgcagctcgatacaaatcaagacttgcgaaacaagtgaacggactttctgcataatacaaaaacgatcccttttacggggatcgtttttttcattcagtccggagaagctcaaggagaaagagctcaagcaggagctgcttgtcctttttccccgttttcatttcataatccatcactgcgagtttctctataatacgccgaagctcttcttcagaaaaaagcctcgcctgatccatcgccagctttacccggaaggggtgaacctttaagtttgatgcgatttgcttttggccgtatccttgtccggcaaaatactttgtctgcataatcagacggaattgattggcgatcagcgccataattttgatcggctcttcgttttgttttaaaagatcataaaatatttgaaggctttccgtccgttttcggttcacgattttgttgatcagctcaaaaatattctgctccaaacttcttgcgacaagctcccggacatcttcaagcgtgatttcttgtctgtcaccggtataggcggtgagtttttgtatttcctgatatatggaagacaggtggccgtttacgagcagaaccaaatgctcggcagcctctgtatcgatcgttttattttcggatttcgccagattaatcgtaaaatcagtcgtctcctttgcattcagctccttagcttcaatcataagggctttttgcttcagcgccttcgtcagctttttccgctcgtccagcttctcatacggagccacgatcacaaagaccgtataaggcgcaggctctgtcagataagtctccagagcgcctgtattgtgctctattttttctttctttttttcccctgttaaaaaagacggattttttacgatgaccagccgcttctcccccataaacggaaacgtttccgcatcggttatggcctggtcaagcggatcctcttcaagatcaaaaacagacaggttaaaatctttcgtcccctcatcaacgactgcttgtctgatccggctgacagtctcttggagcagataagtttcttttccgtataaacaataaacggagcggacatccccttttttcagggctttccaaacatcaaataccatgatcgtatgacttcctctctttcttgatccccttctatcctaaattgagttcggcaaatagtaaagaggaagctttaaaaaggacagcttcctcatttatattaaacgcctgattcacaagctcccggggctgcttgtaaaaaggcgataatcacaagaacagaaaacgttaccatcacttctagatttttcaaaacaattccagtatacttaaggaagtcaggagggatgaaattgaatgattttgaaaaaaacgttcaaagcaaacgaaatgatgctgttgactcagctgtcggttttgtcgtgtccttcggatttttcgcctttttgttcgtgatggcaacagccatccatcttatcggctcttagccgcattccgggctgctgtcaatcggcagtcttttttacttcctgcgccctggtttcttctatatcatatggagggaagacagaaaacgttccggcgccttttttaaatctgtatcgaatagttccgctgacatcggtgcgaagcacattgacagagtaagctttcaaacgatccagcacttcttcatgcggatgatgataacgattatcttttcctgctgaaatcagtgctgtctccggctgaagctgtttcaaaaaggcgtcactcgtagagcttttgctgccgtgatgaccggccttcaatatatcagccttcagattcggatacgttttcagcacctctgtttcgccgtccgattctaaatctcccgtcaaaagccagctcactctgcctaaaaccgtccaaagcaccagtgacgaatcatttttactccttccgccaggcgactccggagacagcacctgaaactgaagatcaccggctgttatggtatcgccccgttttgcttcagcaacgggaatgttgttttctttcgccatattcaatatttccccatccttcggttccttcacgaatcccacggggacaattaaccgcttcactctatgttttttgattaatactccggcttccccgatatgatcctgatccgcatgggttaaaatcagcgcatccagctttttcaccccttttccgttcaaaaacggaactaaaactttctcaccgatagaatacgggtggtgtttttctttccacgattcttcggaataagcaatcactcctcctgtatcaaccattacggtacctttacggtgcggggcacttataaacagtgagtctccctgcccgatatcaagcatatccgcttctccccaaggactgaaataaggacggaacattatatatgccaaaaccgcaaagaaaaaaagagccgatttcctgagctttaaaaaacctcccttttccaaagctgcaaaaagcgtaaaaacggaaaccgcaagcataagaagcgacagaaagtcaggctttgacgcaatcattgtaaataaatcaacggatgccgcatatgtaatgaaatcatgcacaggcttcatcacaagatcaaacaggtaaaacaaaaattcccccgcctgcctggaaagtaagagaagaagaaaaccgatgacagaaaacggaatgacaaataacgtataaaatggcaccatcaccatattcatcggaaaactgacgagcgaaatctgctgaaaatgatagagaagaaacggcagcgaactgagctccgcaataaatgaagccatcgcaagcccggcgagtctgtttttccctgctttctttaaaatggaggatgacagaattaaagcggcgcttaccgcaaaggaaagctggaagcccgcctgccaaaggaggtaaggatcaaacagcagaagcagcagataagacatggacaatgcagctgaggaatgaatgctgcgtttcaaaagagttccggcgatataaaatcccagcatgagggatgcgcgcagcacagatggggcagccccgcttaacaacgtatacaccggcaaaaaaagcagcaacaacatccccgccttttctcttgtcagtccaattctgataagggcataaaataaccccgccgtaataagaccgacatgcattccggaaatcgccattaaatgaacgactcccaaattttgataagcgctcagtatatcgtcctctatagaaaatctttcacctaaggtcagcgcctcaacaattccggcggaagattcaggtacatgattccgaatgatcgaaatcaaattctttctgatgttcagaagcttaaacagcggctgttcggatttttcgcactgcttaatggaagtaacggaaaatatccagtgaatatgctgggaataaagaaattccttataatcaaaacccccgggaaccgtcgcatgtcggggctgttccagtgagcctgtaaacgtacagcgcatccccggttccagctgttcaatgagtcttttttcttcaagggaccggattttgtacgaagcggcccatttttctttgtcatgggtacggataacggctgacattttcgctccgtcaaccttcggaatgtttatgatgagagcctgttcagtatagctgccggcctgataccgggatacattcgcagcgtcacaaaccgtatacagaaagaaataaagacaaaaagaaacgaggcagacgataaccggtgtgtgctgctttgtttttacgataataaagagaagatacagaaggaaaaagaataggacccagaaggaattagcggcggcagttcccgcggttgcagaaaccgccgccagaggcagaagaaggtatttatatttcatttatacgtagctggtaaacagctcattggcctgttcatgaatttttttcagttcgtcttccttaacccccgcatcagataattgctgaatcagcccggctacaaaagacaatttttcacggtttttcaaatcgatgatcatttcatcaagttcaacctgctccaccttgactccggcttggttgaacagctcttttgcgtaaggctgtgttttgtaatcttcggcataatagacagttttgatgcctgcctgaataatcgatttacagcattgaatacaaggataatgcgtcacataaatctcggcgccctccgtcggcacaccgaacttagagcattgcaaaatcgcattcatctctgcatgtatggtccgctggcaatgattatctattaaaaggcatccttcatcagcgcaatggacgccgcccgcaattgagccgttgtatccgccggcaatcatccgcttgtctctgacaacggttgccccgactgacagtctcggacatgtgcttctcagcgccagcaaatggctttgcgccataaaatattgattccatgagattcgttccacaagtgttccctccaaaagtcttgttgctgttctaagtttacatagttttgagcaaaaccgtcaattcactttaccgtaatggaagtttttatccgctcaaatgacttttctccaaaacctgatacattcatcaaatcttcagcagtctgaaaccgcccattttcttctcggtaggcgataatcgcttccgcttttttctgccccacaccgggaatcgcctgaagttcgtcaagagatgccgtattgatattgacagaagcattctccttttcacctgctgcggttttcgggggattcgcctcttcgccttcactcgggatataaacgatcgtcccgtcctgcagctgctctgctaaattaacattcagttcatccgccttttccttcaggccgccggctttcttaatggcttgcgtcactctgtctcccgccttcatttcataaacgccgggatgtcggaccgctcctttaatatcaatcataatcttatcgtctgcggtgtcttttttgtccgtgacgggcgctgaggctgtttggccgagcacggactgctgtttgacaggctcttctttttcggaacgaaacagcaaaatgcagatcaaaaccgcccctgccgcaagacaaacgccaagaattttcaggtactgcctctgccgctccgtcatcatcactttcgtcatattgcattgcctccccgcataaggtttagaggattaagggaaaaaggaggggaatttcattgaaaataggctttatcggcaccggaaacatgggaacgatcctgattgaatcgcttattgaatcaaacgctgccgatccctcacaaatcaccatcacaaacagaacaatcgaaaaagcattgaaactaaaagaacgtttcagcggcatccatgtcaccgaggatcaggaaaagctcgttcaggaaaatgatatgatattcatttgtgtaaaaccgctggatatatatcctttgctgaagaaactcacaccgcatttacgaaaagatcacattttaatctccattaccagccccgttcaaacggaacagattgaacatgcggttccgtgtcagacggcacgcgtcattccgagcattacgaaccgcgcctttgccggtgtctcgcttgttacattcggcaaaagctgcagtgagtctgcaaaagcggatattcaaacactgatcactcatatttcaaaacctgtagaaatcagcagcggcattacgagggcggcgtcagacattgtcagctgcggacccgcttttatgagttatctcgtacagcgctttattgacgcggcagtggaagaaacggacattacaaaagaagaagccgtgattatgtcgacggaaatgcttgtcggtctcggaaagcttttggaaacagggcattacacccttcccgccttgcaggaaaaagtatgcgtaaaaggcggcgttaccggagaaggactgaaggctctcgaaaacggtgtgcaggatatgttcaaccgtgtctttcagcgtacacatgacaaatacgatgaagatatatctttagtgcaaaagcaatttcacgtgtaaatgagtatgccataaagtgctttatcgtgccaatcgctaaaaatgcattttaaaaaccatcgttccgtttaaacgatggtttttggtttgcctgccgtaaagaaaagacgttcagactctcttgaaggaggacggtctgtaaaatcagccgtcactttcttcagttcaaatccgctctccgcaagcatttgttcatattcttcaatgtaaaatgttttttgctcatgcgtctcgtcataacggtcatatgactgtccgttccatacgaaaaaggacatatcatggatgacagatagctcttcatcaccggcaaagctttgccagatatagctgatctgttcatcttgatccgcatgggtgctgtccggaaaaagctccgtcattttatatggggaatggacgtcaaacagcagcaagccgccctctttcaaaacacgaaaaacacttttgaaggtgctgaagacatcatttttcgtttttaagtaatttaaggaatcacagcagatgacaacggcatcaaactgttcttcaaaaccggaaagctctctcatatcctgctggagaaatagaatcggctttcccgtttttttctgctgggcacagctcagcatgtcttcacttaaatcgattcccgtgacttcgcagcccttttcggcaagcctgacggaaatttctccggttccgcaggcaagatcaagcacccgtcccttttccggaagagccgcttcgatccagtctgcccattcatcatacggcgcatgcgacattaactcgtcatatacgccggcgaagccttggtaaatcatgagttcaagccgagttcaagctctgcgagcggcgcgtcgccccatagcttttcaagattgtaatagcctctttcatctttatggaaaacgtgaacaatgacgtcgccgagatcaactaaaatccagcgggcttcatcaaacccttccatctttttgacatcaatgccgttttcttctgcctgatctttaatttcacgcgcaattgcctgaacctgtttatcagaattcccgtggcagattaaaaagtaatccgctacaagagagattccttccatgtccagcgctaaaatatcctctgtacgtttatcatcgcatgcttttgccgcgatttttaatacggaagcttgattcatttccatattcctcctgtcatttttgagacaccagccagttataggttgcaaacgtctccgggaagaccggctggttttttttcatcagaaatatcattgtatttttcatcgcttgtatgagcgcttcgttcagatctgtttccgccagatggcgcacctcttccactcccggaaaatggcggccgggttcaatgtaatccgccacgtaaatgactttgtctaaaagggtcattccgggacgccctgacgtgtgataacggatcgcatctaagatctcggggtcagtgatccccgcttctttctcagccagatacgcccccacaggagcatgccacagctcggcattgtaatccaagagctcagccggcattttttcccgcacgatgatctgcttcatttcttctttcggccggaatttcgcataatcatgaaaaatagcagccatttccgcttttttcggatctgccccgaaccggcctgcgagaataaccgccgtatctgtcacgccgattgtgtggatatagcgatgctcggtcagctgttctttgacgcaggcaagtgcttcctcacgattcatataaatcattctcctctatatactgcctcacttcatccggcattaagtattgcgtcggtttttttgctttcagacgttctctcagcatcgttgacgaaacgccaaactccggaacgtcagcaaaaagcagcgggtacggggtctcaatatgataccccggacgccgcactccgataaattgaatgagcttgagcagttcgtccagtttgtaccatttcggcagatattcaatcatatccgccccgataataaagaaaagcttgtcgttcgggtgccgctccttcagtaaacggacggtatcataggtataagaaggaccttcccgctccatttccgccagctcaagcttaaagccgggattagagctgatggcaagcctcagcatctccacccggcgccggctgtcggtaaagtcttcattctgcttatgcggggggatttgattcggcataaaccaaacctcatcgagctccgcctgatgaaggacttcattagccatcagaagatgaccgttgtgcggagggtcaaatgtgcccccgaatattccgattttcctcatgtcaaccaccttacggaagctcgatttgtttattttcctttgattccttatacaatacgatcgtatttccgattgtctgcaccaaatgtgcacggctgcctttcacaagggctgccgcgacatcatttttatcgtcttcgcagttttgaagcacactgactttgatcagctctcttgcttccaatgcctctgcaatctgtttcaccatgttttcgttgactccgccttttcctacttgaaaaataggcgttaaatgatgcgcttttgaacgcaaaaaccgtttttgttttcctgttaacattgtgttcctcctagttttccttcaacaattgttctcatcaagccgctgtcaggctcttgttccgtccacagcttgaaagccaaagcggcctgttctacaaacatgccgatgccgtcaagggttgttaagcctcttttttcagcttcttttaaaaacgccgtttgaatcgggttgtatacgatatcacaaacaatggcgcccgttttggcccgttccaatgagagcggcacggcatccgtgttcggatacatgccgacagatgttgtatgaataatgacgtcatattgctcaagctgattttcagcttcttctaatgtgagggcgcgtttctgctgaaaagagggagcggccgcaatcaggctttctgctttttccggcgtgcggttgcaaacgtcaaattgtttcggctctttgcggacaatcgtcgtaaaaatcgctcttgccgcccctcctgctcctatcattaagatggagagctctgatatgggtttgtccaatactttgaccaatgatttataaaatccatctccgtcagtattatacccgatgagcctgtctccctctcttttgacggtatttacggctccgagtactttcgcgctttcatctatttcatccaaatgctccatgatcgcgactttatgcgggactgtgacgttaattccgcagatgccaagcgccttgattccgttaacggcgtccttgaggttgtgaggttctacctgaaacgcaaaatactgcccgttgatgttcttatcttttaaagccgcgttatgaatatcgggtgacattgaatgcccgatcggatttccgattactccgtacaattgtttcatgctccctctccccttctctctatattaatgatcggcggacaaatacgtgtacgcctttcggagcgtatgccgttatttttttatctgcgttctgcaccgtgacccagccgagaccggaaaaaacgatatctgtctttccttctttaatcgtaaacgtgtgggccgtaagctccggaaattcatccaaatgatcttttccgggcggggtgagcagttcacccgcatgcttttcgtataaggcgtcagcattttcaagctttgttctgtgaatcatcaattcattcggcatatagcagacaaacgccgatttatcgcctgaaacataatcaaaacgtgcgagcccgccgaagtaaagcgtttgtttctcattcagctgaaaagtgcgcggcttcagttcttttttcggtgtcagcacctttaagtcacgcttgtccacgtaatgcgccatctggtgatggttaatgattcccggtgtgtcataaagcgcagatccgtcatcaagcgggatttcaattgcatcaagcgtcgtccccggaaattgagaggtagtaataatattctcttcccctgagacctctttaataatccggttgataaacgttgatttcccgacattcgtacagcccaccacatacacatcgcggccttcgcggtaatgttcaatggcgtcaatgacttctttcattccttgtccgcgggaagcgctgattaaaaagacatcaagaggttttaagccgtattctttcgcttcgcgtttcatccattgaacgaggcgttcccgttttacggatttcggaaggatatcggccttattgccgacaagaatgatcggattaccgccgacaaagcggttcagtccgtttatccagcttccgttaaaatcaaaaatatcaacgactttgacaataagagagtcagtatcgccgattgtgtgcaagatatttaaaaagtcatcatccgttaatgaaacatcttgaatttcattgtagtttttcagtctgaagcaacgctggcagatgacattctcttttgtgagggatgcctttggcgcatacccgagaccttgtttatcttcggtctggatcgttactccgcagccgatgcaaacaaccttttccatttctaatcctcccactgaatatggcctttacgtttcaaagaactcaatattctccgttcaatccggcggttaaagcgcgtcatgaccccgtcagaggaagcgacaggcacgacgaggatcgtatgatacccatgtctgtttccgccaagaacgtcagtaagcagctggtcgccaatgaccacacagtcttcttttttcagatccatgctgctgacggctcttttaaaggcgcgccccatcggttttcttgccttataaataaacggtatgccaagcggctccgagaataatttcactcttcgttcattattattggagacgatcgtaactttaatgccgtgctccttcatttcttcgaaccactcgattaatcgaggtgtcgcactcggtctgtcccactccacaagcgtgttgtcaaggtcagtgataatacctttcacattgcgctccttgagcttttccggtgtgatatgaaatatatttttcacaaattcgtcaggtaaaaaaaacttttttaacaaaacccgcacccttcccttttctttctatcatctatatgtcgaaatctgtcagatttaaaaataaagtcggactgagcaaaaaaatttcgacaaaaattgggtttcttcaccagttgtggataaaattacacacattatccactcttattacatccggatttatccaaattataaacaagatactaacaagttatccacttgtgagtgtggataacagaacgattgttcttatttgtatttcatggtagattaaagataacctcaccatgattgaaacgcaaccttcatcatatgcttgcgtctgatgattgattacaattattaaggaggtgccactcccattaattgggtccccggcatgagaaagctttctgatgaattactaatagaatcttatttcaaagccaatgaaatgaatttgagccgtgaatttatcgagttaattgaaaacgaaatcaaaagaagatcgctcggacacattatttccgtttcttcttaaacagaaaaaattttccgggcgaatttcctttttttactcagatgactgatattatatcacttcggttatgcgctttactaccactttcaacaaaaaacacccctaaaatagaggtgtttaagaggacggctgttattatttgaaccaatacagaccgcccagaacgagaaaaacgacgagcaggacgacaaaaaatgcgtaccagtaccccgcattcacccgaggaggcgggcatacaggatattgcggagggaaaccgccgttcatagcatatcgcctccaaaaagatgtttttctacagcctatgatgcaggagcaaaacggcttaggcagctgacagcgtcagcgttccaaaacccgcccattttttatgccttcaattaagattctggccccttttggcgtcatgtgatttccggaaggatcaatcagtccggattggatcagcgcccggtctgtagctttgccgccgtccgcgcgtataaagtgtttccagttatccaccagaggcacttttaactcttttgcaacctgtcttgtaatgccgttataggaattatgccatttcctcgctccgcctttttctttaaaggctgaggccttatatcttgaatagtaatagagatgatgcgttccgtttccttctataaccgggatgcacgtcattaagatcggctttatgccgtgttttcggctttcgtttataaaataagtcaggttttctttaaaccttttctttgatactcgcggctgatctcccgtcaaaatgcccgcatcatttgttccgaacatgataaataaatattggggcttacggtcaatcacgtcgctttgaaagcgcaggcgcgcatcttcagtcgtctggccgcctattcccgcattcacaaccgtaagacggccgcgttccgttgtttttaaaatgtttacccactgctgcgcctttggataatcacgataatcccaattggaaccgcgcgtattgctgtcgccgaacgcgacaacacttttctctttgcctgcggcgcatcccgataacagacaggttatcgtaataaaaagaacagcaaacttcattttctctccccccaaaccttacatcctatggtacacatctcttttgcggctttcaacgcggcgctctctttaatgaatatgaaaagggccggattcctgtccgatcaaatccgaaaccttaacaaatgtgtagccctgttttttcagctggggaatgatttctttcaaagcctcaaccgtctggcgccggtttcctcctccgtcatgcagaagaatgatatctccatccctggcatgtgagacaacatgcctgacgatttttccttttccgggccttttccagtccatcggatcttggttccatgaccacatgatgataaagtagccctcttttaaaatgcctttgaaagccgtatgattcagcgatcctcccggcgggcggaataacttgtccccttccggctgaagcgatctgatatgctgcgcggagctgtgaagctcttttaaaatttctttgcgtttcagccggtgaaaataaacatggttcatcgtatggttgccgatttcatgcccttcttcaatgatgcgctttgccgtaatagggtatttgtctatacggttcccgatacaaaaaaaggttgctttaacattgtgctgtttcaacacgtctaacacagcctccgtatagacaggatggggaccgtcatcgaaggttaaagatagtttctttttttcagaccttatatcccagtacacgtttcccgtcttctccatgtcacttctttttaatgatttcgcatcggcggacacggcagtgagactcgcgaggacgcatatcatgatgatcagatgaaagcatctcaacgtttacacctccagtaaacactactgttaacgtgtccccttttttaaaaatcattctgcacattaagttatgtacatcacccgcttctgctgtaagaagcaggtgatactgatttatgacagcaccgcttccagcttgtcttttgttttcggaccgtaaatcccgtcagcctgcaaaccgttcattgtttgaaaacgttttacggcattggccgttttcggtccgtatattccgtcgattccatgatttttcgcatgtttatcaggataaaaataagcggcggcaagggctctttgcacttgagtcaccttttcgccctttgtataaggggtcgtcagtttaatgattcctgaaggcagcgggtagattttaggcgccttatttgcagagtcgtcagtgccggttatgccttttttaaaggattcccagctgttcagcagcctgtcggggcaattctttcctgaccattttttatggggaacgacgcggtcaagaggtatatgataatctttcatgagctttttaatgagccattgcgcatttttcactgccttatcaaaatcaccgtcagcgttttcacaaatttcaattccgattgacttccgatttcctgtcccatttgttccgtcaccggcatgccagccgttctcattaagcggcaaatgctgataaatctcagaatcatccaccgtaaagtgccagctgacggcagtatccggctgtttcacataatttgcatgcatcttcgcgtctgcgcccttgtccgtgttggacgtattatgaatggtaatatagtccggattcatggcatatcccggccgattgccgtttgatttcggtatcaggtctttttttatggataccattttatcccctcccctattaaataatgcagaaacacgcttatcggacagcctgttttaatagaaggagatagatttgtgctgtatactatttgaaaagaggtgaacgtgcaaatgataaaaaaaggattcagtcttgccgtcatcattgctgtcgtgatgatcggctttatgcaaaaagacgtctggctcggcatgattcggggaggcggaatgtacgccgtccttatgagtatcctgctggttgcagcagacgtattttttccgattgttccattcgccattatcgcggccttaaatggagcggtttttgggattgtaaacggggtgtggattacactgtccggcgcgatgctcggaacaatggcattgttttttctcgtccgttacggattcagagactgggccagaaaaaagctgcgtgcttacccggccgcagcccaatatgaagattcatttcatcagcacgcgtttacggcggtgcttttcgggcggctgattccgattattccgtcgcttgccatgaataccgtctgcgggctgagtaacatacgatggctgatctttttttccgcgtcagcgctcggcaaaattccgaacattgtgatcgtgacggtcgcaggcgcttcatttacaagcaacaaactgctgtctttcgggatttacggaatgtatatgctcgtgttaatggcagtcatttataaaaagtttcccggtcttttaaaaacaacgaaaaaatgaagcgagtaccgccccctattccggcggtacggctcctctcattctgagaacctttccgttcaatttcgaaccgaccgcttccaggtttttctttttgtaaaatgagagggccgttttattgtccggagaaactctgaaatgatattccgaaacaccgttcgttctgaaaaactgattcgcgtattgatggagcttcgttccgcacccccttcccctctgctgctcagtaatatagtaaaggtgcacataaccgattttttgattaccgtacgatttgacggaggcttcaagctgtccgatcggctgcccgttatgaaaaagcagcataaaaccgtcgggaaagcatttgatttgggatgacagccatctgagatattcatccttattaaattgagccgccgtgccaaagctgacgagaaacgaatcttcccgaaatgaaacggccgtctctttatgtttgtttaaattgattgatccgcttgaaatacatcgggtgtcctcctttttgaggccgcaattaagaatgagcataaaacagctgccaacatcagcataacggcagcgcctgtgatgacgatatggcggatggaagaactgactgccgccgctccgaacacggccgttatcaatataatgaagccggcttcaactaatgaataaaagctccccaccctccccatgatgtccaccggaacattcttttgataaaacgtcagaaatcccgtattggcgaatgccaggaaaaaagccagaaagaaaaatccgaaagcagccgtccaaaaaccatcagaaagcgcataaatcatatatccggcagctgtgaataaagagcccattcccatcaataaagaagccggtatttttttattaaacaacacattgacaagcgcccctgcaataacgcccgccccagacacactgacaagaaaaccgtaatcagcatcagtcagctgaagaacctcttttgcaaaagcgacttcaagcgaatcaagcgcagacaacataacggtcatgaccagactgaataaaaaataaatgatcatgacgtttcgcgccgttcggctgaagcgatatacgagcttccagtcttctttgtacactgcaaaagaaagcttctgtctgggagaatgtacatgaggttcattttcaaggtttggcagcatcattgtgataataccggaaagcattaaagctgccgtattcacccaaatcgcaaaaatcggcgtgccgatgataaaaagcagcccagtcgcagccggtccgaggagaaaagcccctgattccagcaacgccctgagtgaattgaattgttttctcctttcggccgggataagcatcgtcacgtacgccatggaacatggacgaaacatcgcattggccatttgaatcaaaaacacgatacaataaacggaaaacagagaccgtgcagtaaacatcagcggcagaacggcaatgaatgcagcccggatgaaatcaagcgacatcatcatattccgtttgttccaccggtcgatgatgctgcccgcccagccatttgtcatcaaaacagccgcgggcctgattaaatagagaatggaaacggcaaaagcagatcccgtttcttttaagacaatgagattaagagacaaaaaataaatccattctccaatgtttgctatcccgattccggttaacaaaagcaccgggtaccgccaagacttccggtttttcatcatatcccccctcaaaaataaaaaaacgccctcaagacaatgaagtcttgaggacgggaaacagcccgctatgccacctcaattcggtttggtgccggccttgccgggtacaaagcttactctgtaacaggagtatctgccgcatcatcctcgttttgcatgattccgatgcgaagctaagaggtttgtttcaacacatccattcatactccttcccagctcccggagctctctgtcatgaatgatatctgcctactcttctcttcagcgctttttgcgtatattcttttcgctcttactttttttaacaatatacaggctcaatcaaaaaaaatcaagaggccttcagaaataaaacctgcctttgattaatttccctgtacagacacagacagcctgactgccacatacagttacatataggcttttgcctacataactttgtggaggtgaggatggtgacaggtgtttttgcagcgctcgggtttattgtgaaagaactcgtgtttttagtatcatacgtgaaaaataatgcctttccacaaccgctctcaaataatgaggagaaaaaatacttagaccttatggctgaaggagatgaacacgcccgcaatatgctgatcgaacataatctccgtttggtcgcccatattgtaaaaaaattcgaaaacacgggagaagacgcagaagatctgatctccatcggtacaatcgggctgattaaaggaattgaaagctattcagcaggaaaaggcacgaagcttgccacctatgccgcacgatgtattgagaatgaaattttaatgcatctgcgcgccttgaaaaaaacgaaaaaagacgtctcccttcacgatccgatcggccaggataaagaagggaatgaaataagcctgatcgatgtcctcaagtcggaaagtgaggatgtgattgacaccattcagctcaacatggagcttgaaaaggtcaaaaaatatatcgacattttagacgaccgcgaaaaagaagtcatcgtcggccgcttcggacttgatttaaaaaaagaaaaaacgcagcgcgagatcgcaaaggagctcggcatttcaaggagctatgtctcccggattgaaaaacgcgcattgatgaagatgtttcatgagttttaccgggcggagaaagagaagcggaaaaaggcgaagggaaagtgagcgaaaagccggatctgacattccggctttttctgttttttattatgtcagtcatggtggcggtgttattaagaaactcttccacactcaatcttccatcattgaacgtacttcctatgaaaaatgattttgaacctcataggaacccttacaagacagggtttttgttgttttttttcattattcatctcaaaaaaaccataaaaataaggagtgacatattagtcatgtctaatatgtatcactccattagttcttgttcaataatcccacccgattgtggaagatcgttattaaaaattttcaatgttagtttgattttcatacatactaataaaatcttatttaaactttacaagacaagctgaattgactatagtctaattagactaaaatattgatgcaaagaagtgaaaaattagatgataaagtcttttttaatgttggggcagtcgaatatggcgggccgtggatttttgaatgaagtagatcctatctataatgaaaaaataaaaatgctgcgcaatggacagtggcagatgatgacagagccgattaattacgaccgtccggtttccggcgttggcctggcggcatcttttgcagatgcatggtcgaaagctcatcccgatgaagaaattggcttgatcccttgtgcggaaggcggcagttcattgaatgactggcatccggaaggcatcctttttcagcatgctttgtccgaagcccgcttcgccctcaggtccagtcaaatttgtggaatcctttggcaccagggtgagagtgacagttatcgttcgctacatgaaacttattacgagaaattaactcttatcatcgagacgctaagaaacgagttgaaacttgatgaggtaccgttgattattggagggcttggtgactttcttgggaagactggttttggacagcacgcgactgaatttcgacaggttaatgaacaattgctgcattttgctaatgaacaacagaattgttattttgttactgcaacaggtttgactgcgaatcctgatggcattcatttagacgcagcttcacaacgcaaattcggttaccgctatttcgaggctttttcgaaaaagcgccatatcctgaaacccatttcgggagaggagcaatcactgaaagtgaatggtgactattctaaaacagaacagatttaccttcatagtatggatttggcttcgggtaaaatcacgtacgcggaatttgaggcgcggatggcgaaggtgatgaaatcataattcccttacttatccttggcttgttaatccaaaaccccggagctcacggctatgaacttctggccttaatggaaaaacgtcattacaaatacattgttaacttcacgaaaggttcattttattacaatctgcagcaacttgaagaaaagtgtttgattgaacagattcagcagaaaccctcaaccagcgggcgtgaaatccgtaactttaaagtcacagaagcgggaagggcagaattcgaaaaattaatgatcaaatacggcaccaaatcggaatatgtgaacctgcaattttatggggcgttactctttgccgatgaattcgacaaaaataaattactggatctgattcaatcacaaatcgaccagactaaagctagaatcgagctccttgatgaatacctgtccatcactcaagaaattcccggcacaatcaattattttcgccgtatgaatgaaaattcccgttcacatcacttggttaatttagagtggttcgaaaaattgaaagcagaaatagagtgactattgcataataaatataaaacctgtgtcgcagatatccagtaacatcattgatacaggttttatactccttctttaattaaaccagtaatagggttgtcaacacttgcccccaacaagagcaagtgaatcatctgctgtgtgttcttctttttcaatccttcgtattaatagtattcaagtaagtcaactgatttttctccttcttccgctattgaacaagcagtgaaggtgaacatcgttctcgacataaactaaaattttttatatacctctgcgtaaacaactttcaattgattgatattaaacccctccaattggacgtttttcctatgaaaaagaccgcgaaaaagaagtgatcgtcggccgcttcgggcttgatttaaaaaaagaaaaaacgcaacgcgggatcgcgaaggagctcggcatttcaaggagctatgtctcccggattgaaaaacgcgcattgatgaagatgtttccggtaactttttttaaagatatttgtttggattcaaaaaattccaaaaatatatttatatactcctagcaacgctcgctttaaccaattattgtaaccccccatgtttacagagctgattaataaactatacgagggataaacggataaagccttccccttctttctgaggagaaaatattaaaaggcggaaagcccttctcgttatgagagggctttttaatacggagaactcaccgaagaacaaatcacttgtctgttgtgggatactgccgaaaataaatcacttcacaacagacaaactgacatttggatttattttctggttcagttatctccatccgttagtttaattagaattcagataatccaagacacgatcaactctttcattgactgagtaatctccttcaatttttaacaatggacaagataaatctgccatccaatgttcgtgtaaagctctacttctaacttccattccagcattatcatataaagaagcccactctaaaaatgtttttgattgttcatatttactgccgccggctaacacttcgtttccataacgctgaaattccctatgccttaatctctcaagccgtatatcttgcggaacccataagaagatgacaaggtcaaaataactttttagatcatcgccccagccgcacactgcgccagaaagaatccatttctcattgattgtcaagtctttttcaagcagctttcttcttttaggaatttctctttttttagtgaatttatctgtccaatagtaatcatcagtatcaagatgcgtatgaggcaaatgctttgataatgcaacacccaatgttgaagttccgactccagaggctcccagtatgtgaatattttttttcatagttccctctccttatgaagcaacgaaactccctgtccgctgcacaaggttcttactattattttaacataaatccccaaaaacctttgctttgatagggaatccagatgcgtgttaaaacccatactgcttacgaaaacagtccttattaaatcgtgatttccctataatatttaacgaatcaaattttagattaccgtctgtaagtttttttcatctcgaggtatatgacctgaaaactgagttttaccgggcggaaaaggagatgcggaagaaatcgaagggaaaataatgtcatagaagcaggtctgaaattcccgcttcttttcattccgctaatcccttaataatcggtgcaggcaatgtccgccggcgcaatatccatcagagtcgccaagctccgtcctttaatggctccatattatttatcatttattaaccatcacacagaatgattaactttctctccgacctattttatatcctcatacactttctcaaaagtctcgatcggcagtgaaaacttggttgttttctcgttacgataattgatcacgatctcaatttgattatttttttgttcaaactcaataagcgcattctcccttttatctctgattgaaatgatacaatttccatttttcttttcctttttcttataaatgtaattcaccttaactctcctttcgttgatcgacaaaaggtttctgaataaggaagctcctcaaaaaaaggatctaaacttttatcaagtttgatccttttccctttttagtcatttctccgtgaacgtttatagacattcatggttaccagccagctcataacgatgattcctgcaaaaagaatcagcatattactgtacaaataagcggaatgatcagcgttaacaggcagcagcatttgatccagcaagcggattgataataaaccgcctgtcatcgcaatgcccgttccctctgataaaaagctcgtaaaatttagcagactcattccgacgccggcttccttttgtttcaaactgccagacacaattgtagatataaccgtttttgtgaaggagagccccccaaaaacaaaaacgattataacggtcatgagccagggtgtggcatctataaaaaaggcagcgattaaaaaactggaagacatcaatacaattccaatggtcagcacatacaaagaacctttccgatcaacaagccatcctccaatgtaaccgaagatgatgacgctcatcgttccgggaaacataatcccgcttccaattgccgcagtacttaaatggtgaacatctttcatcatataaggaaccatagacacaaatcctgctgcagtgccgaatatcagtccgccgcaaaggacgccaatcataaacaagacatttttccccagtgcagggtcaacaaaaggttcttgagttttcctaatatgttttacaaatatcaggaaagctagaatactgatgatcagaaaagatagtctatatgatgtcgtaaacagcataaaaaacacgacacctgcagacattaatataatccccgtcatatcaaagcgcccgctgattctttcttccttttccagcagtttcatcaggaatggaacagtaatcattgttgctgttggaataagcagcaaatatgaccaatgaatataatgagcgatcattccgccaatagctggtccgacaccttcccccattgccaccaaagacccgatcagaccaaatgctttccccctgttttctttcggaatatagcgcactactgcaaccatcacaagagccgggaatgcggcagcaccagccccttgaataaaccgtgccagaatgaggacaggaaagaaagagtgtccgacaaatccaatgatcgatccgaagccatttaccataatcccaaataggagcagctttttgatccccagctgatctgataactttccatacagagcagttccgatggaaaaggttaacataaaggctgtgtttacccagtttgcactcgccggcagtttatgaaaatcgttggcgatatcaggtaatgagacgttcaaaaccatttcatttaatacgctgaaaaatgacagaacacaaagccaaatgaacacttgattgtgccgtaaagttgactgtgaataaggcgtattcacaatttcccctccattaatgagggcagacgcagtttatagggccattgatacgcttccctcttttaattgcaccctgttcttttttttacacttcatacataactccccctgcattgattgatatatcttattatatacagactaaggtatagaacaataaggctcgagtgcgaaaaaaagaaaaatcctcaatccgatattatgaaacattgcgacacacacccgctgtatgaacaagatgaccaaacatcaaatactgttatatttaaaatgtacagtaccaaaaaaccgcaatttcatttgctgttgaaaaattggaataaagcattgcatcgaccgctcctatgacaaagttatttttggcataaaaatgacaagctgaaacataaggttcagcaaatatctcctctgtatatgtccaaacattgttttcaaatgaagggataattctccctgaaacatattgaatcgagtcattttagttatcataataatcaccttcctgcatttactgacctcactttacatcttttgaactgtactgattaattcgtctgcatgtcatggacaccggtttaacaactttaagactaaaacaaaaaagataccaacatcgattggtatcatctattcattcgagcccttacaacaaaagcctatttcggagcgtccaaaccaaatgttatccattcctcttttgccggaccataaatacccggaacagttaaacctgcttgtctcataaggacagtcatttgtcctcggtggtgactttgatgttgaattaaaaacatcaaaagtgaaccatttggcaattgctgaccaataaagttgatacattcttgcagggtattgtcagtccattgcgtttttaacgcctgtacaaatgcattactggcttgatgatagctgtcagctataaactgagcagaagcgggaacaggataatcttcagctggggcatgaaacgttaagttggtgtttgaggtaatgatgtgaatagcagcaacagtatgccaagcaatacggcctaaagtccaatgttgtgaagtgatttcttgtttaagtgattcatcagtcagctgattcagcagtttctgtgtcgcaccggcttcgaactcccaagatttcaaaaaatggtctaaggtttgaaacacaaaaatcctccttccttttttgtttttctatgtatctacagttcaattatagtgtttcgtttagttaaaaagaacagaactttataccaacatgatttaagaaaaaaggctttgcctcagtttcaaatgcttagaaagtttccgctgatggagctcctgatggtgatgtgacagattttaaaaggatataattgaggagtgaatcttcataaagaaaaaacgataaattcctgttacaggacgaacgagatccagaatatgaataagtttgaagataaagaataattaactctgctccagcgtatacaaaaatgcttgttcatacccctgctttctcattgtttctgcagcgctaatattctcataatcgtgtgcatgacgctgctttcctcatttgatttgatgacaaagtgcgccgcatcttttatttcgtcaatggcgttcttgaccgcaaagctgtaggatgccgcttccatcaactctctgtcattgcggccgtctccgaatgccattgtctcatcaggcgaaactcctaataatcgctgcagttcttgtactgttgttcctttatgtattccgatatttgaaatgtcgatccaggtatcttctgatgctacgatataaaactggtgaaaaaattcatgcagcttttctctcgtttccgggcagttgccgtgagggtcatgaaccgtaattttgataaagtcgtcttttatctcagtaaaatcagctattttcgttacatgtgcataagaggcatttacatatctcatttcactttcagacaagttttcttttaccatcgcgcctttttttgtgcatgcaataatgctgtgcccgcagctgattttttctaaagcctctataattgacagtcccgctttattgctgatcaaagattcatatacaaatttgccgttctttttcatacgtgtggcactgtctcctaaaatccaaaaatctttcgcatcttctccgaacaacgcttcaaccctttcacactgctttccggtacagatggcgaaggcgacacgctgttcctccattactttttttgtcttttcaaataacgttctgtcaaagctgccttgattatttaaaaacgtgccgtctaaatccgtaatgactaatttaatcatcgttcagcacctccgcagttgaaccctgtctctttcagacaaaaggtttttcatattttagaatggaatcaatcgcgtttaagaccccttcttcgttatttgattgcgtgatatgcgcggcagcctgtttaatgctttcttgagcgttatccattgcgactccgtatttcacagcggacaccatctccaggtcattaccgctgtctccaaaggccgcgcattcttcattattgattccccattgttcctgaagaagctgaatcccgcttgctttatgaagcccgggtatgatcagatctatgtcaccgtgtccgcttgatacaggcgtcacaaaagatccgatggtgcttttcaaatggctcagcagtgcggaacaatgttcggcgggaaagctgacggaaaatttaaagatgtcatcattgatgttttcaaaatgcggcaccctttttaacacataataatacttactggcatgcagatattcatcttcactggcattttcatgaatatacgcgctttttttcccgcagacaatgacgtttttcacttcatactgctctaaagcacggattactgcttttattgtgtcttcagacattttacccgcgaataattcttttccggcattcacgacgagagcgccattttcggcaacgaaagcaatttcattcccgatttccggaaagaaggatataagctgcgcatattggtttccgctcgctacggcaaaatgaattccccgtgcttttaattcacgatactggttcataaaacgctctttgttatatgccatttcatcattcagaaacgttccgtccatatcaaccgctatcagtttaatactcatatcgtcctccttttttcagccgctcccattcaaataatgcgtatgaacgaattatatccgcagttgatccgtgacgtaaacgtttgacgacgccttgttttgaatgacacaaaaagtgatttgtcacatgaatataacactatgtaatatgttacgattagatgtacggtcactattctcataaaaaggagaatccccctgcatgttcacacacgaaatgattgcttcatttaacgagcttgaaacttctttatacaattacatctgccaaaacagcgagaaagccgtctatatgcgaatccgtgaattggcagatgaaacccacgtatctacggcttctatattacgtttctgcaaaaaaataaactgcgaaggattttcggagtttaaggtcaagctcaaaatgtatgctgaagctgataaaaaaacaactttaaagagctcccatcattccgttaccgagttttttgaaagaacagtaagcggtgacatggaagaaaagctgaaggaagcagccgcccttgtggccgatgcagaaaacgtcatttttatcggagtgggcagttcaggaattcttgccgaatacggagccagatatttttcatgcttagggaaactttcaatgtatattaaagatccttactttccggtccattcccatttccgccataacagcataacaatcgctctgtcggtttcaggtgaaggccattctacggtgactcacctgaatcagctgaagcaagaaggcagccgggtcatcagtattacaaatcataaacattcaaccattgccaaaatgtccgatgtgaatctgtcatattacgtgacggaagaatgggttgaaaatgcgaatatcaccacccaaatccccgttatgtacatacttgaatctatggctcgggaaatatacaaattgagagattaaatcttgagcaccgatgcgctatgggaatctttcgtggttaatcatcatgaaacatatttagctgccgacacttccgtaaataccgttaagaaacccctctctgatggcagagaagggttttgaaaattacagatgagacacgatacattctgaatgtcccgtaagtttatattctcccaaaccggaaggcaggagaatatgatcaccttttttaaagtgatgttcttgctcgccggtaaccatcattcctgcgccttcgattacactgacaagaaggaagggatgattctggaatagatttgcttcaccttttacatcccacttttcgactgaaaaataaggacattctattaatatagctgcgagcagatcatccgtttgtttatattgaacagtcggccgttcacggaatgatggaacgtctatgacttctgcacttttttccaaatggagctcgcgcggcctgccgtctgcatcctttcttccgtaatcatataatctgtaagtcgtatctgaattttgctgcgtttctaaaatgagtgtgcccttcccgatcgcgtgaactgtgccgcttggaacaaagaagaagtctcccggctttaccttaactctgttcaggagcctgtcccattctccgcgctcaatcatggataccagctcttcttttgttgttgcattgtggccgaaaataatctccgcatctttttcacaatcaatgatataccagcattcggtttttccaagttctccgttctcgtgcattttggcaaagtcatcattcggatgcacctgaaccgacaggtcttgggctgcatctaaaatttttgtaagaagaggaaaacggtccccttcaaggtatccgaataaatctctgtgatgctcccataattcaccgagcgtacatcctttataccttccgttttgcactgtgctctgcccattttgatgagcggcgaatgcccagcactcccctgtccgctctgacggaatattatagtgaaaagcacgcaaggcggtgcctccccacattctttctttgaaaaccggtttgaaaaatatcggttcaattgacatgatcatcccccgctttattcgatttcatccagaagctcaaacgcctcttcttttgtctgtacggagagcagccttttccgatagttgtcatccatcagttttcgggataacatctgcaatattttcaaatgctgatttccgccgctttctttcggtacggcaatcataaaaatcagttttgcatcggatccatccaggctgttccagtcaacacctgaacgctttatcccgaatgcgacactcggtgttctgacggcttcagactttccgtgcggaattgcgatattcatacctatcgctgtggttccctgctgttcacggctcaaaattgcttgtttaaatccgctgtcagaaagcagcatgcctttacgggacaatttctgaatcatttcatcgataatgtcatccctggtttctccggttaaatgcggttcaatcaggtctgtgctgataatgtcagttaatttgctgatgtcagtcatcccgcctttttgactggcctgagattgttcctcggtttcttttgccgctgcagctgtatttggttcggcagccggcggagcttccccgggcacgggggatttcgccatatcttttttcagtacattaaccaacagagcggtgacaagagaacctgctgttacagcgataaaaaacattaatacatgatcaactgccccaagcacggcaactatagggccgccgtgtgccactctgtctcccacatggccgatcatcgcgatcaccgagccggtcatagaacccgccataatactcgggattacacgaagggggtcttgggctgcaaatggaatagctccttccgtgataccgaaaaggcccattgtaaatgaagcctttcccatttctctttctgatgcggcgaattttctttttcctaaaaacgtcgcaattccaagccctatcggcggtatacagatggcaacggcaatcggccccataatttcataatttccttctccgatcattgccgatccgaaaagaaacgccaccttgtttacgggaccgcccatatcaaaggagatcatcgctcccaaaatcaatgccaggagaattgagctcgaacctttcattcccgccagccaagccgttaaagatgcgaaaatttgagctacgggggcaccgatcaaaaatacaaacgccaaaccgacaatcagtgaagcaaacaccggaataataatgatcggcataatcggctggatagcttttgggactttacattttttgattccaagcgccgcataccccgccaaaaacccggcaatgattcctccgagaaatcctgcgccgcttgcgctgtcgtaaaagcttccggatgccgcaatatatccgccgatcattccggggaccagccctggcttatcggcgatgctgaacgcgatatatccggctaaaatcgggatcatgaatgaaaaagaagcactgccgatctgttcaatcgttttccaaaaagactcatccggaatgactaagccctttggtgttttttctcctccaagcgttaatgcaaccgctatcaataaaccgccgactacaataaaggggaccataaaagaaacgccgttcattaaatggcggtaaatcgggttttgtttttttccctgctgacttccagattcagcttttgaagctgattgatagacgggcacttcaccgctcagtgctttttgaattaattcttccggtttgcggatgccgtcctgaactccgacagcgagcagcttttttcctgtgaaccggtctttattcaccgaacgatccgcagcgataatgattgcgtctgcttcccggatgtcctcttcagtcagcttattttccaccccgattccgccctgggtttccactttgatctgaacgcctaatctgccggctgctttttgcaaattttcggcagccatatacgtatgggcaatgccgttcggacatgatgtaatcgctaacagtttcatataaatcctcctctgccgtttgaatatcaagatcttgtctcaactttatactgaattcataccttaattagcgcgtttttttaccataagttccggaaataacggcatttttccctataaacagaaaaaaagcagggagccattccctgcttttaatagtttaaataagataaaaacgtcatcacatttttttcttccgtcagtttttgaatcaatgccggctgctcgctgagataggaaagctcactgaataattgctttaccatgttttgatcctcatgtttgacggcaagcataaaaacgagcgacactttttccgtcccccattcaatcggctcttttaaagtggcgattgcaatggctgattgtttgatatatttggagttagcgtgaggaatggcaatacccgccccgatatttgtcgccgacattttttctctcattactgcatgaatgccatactctttttctacatagcctttctcatacaaagcacgtgccagctgttcaatgacctgatagcggtgctctgtctcttgctgtaaaaaaacgagaaacggagtcgtatcattcagcattttgaacgttttttgctcccggcggtgcgatgtatcaagctgtccaataaatgcgctgagctttttttcatcagcaggctccaaaagcggtgaaacgacaatatgagggttcgttacatttccaagttctatcgtagaaatgacgaaatctatctctttatgctttttgatatactctgccagctccgcttttgcgatgcagtctattacggtaatgtcatgaaatttccgttcaattttagtccgcagcaattgtgacataccaatgcccatatggcagacgatgatcgcccttttatggctgtcactgcttcggcgcagacgctcgatcgctgcctgaaaatgcagcgtcaaatatgccgcctcttcttcaggaatataaagatcaaatgtttgattgatgtcttccaagacgtcgatgataagatgaaacaaataagggtacatttttttgatgtcgttaagcatggggtttgaaacagagagatcatagctcagccgcttcagcaccggatcgagatggatgttcaatccgttgatcaattcttggtctttatggaaatccagcattttcagctctgaaacacgattgattaaatgcctgacgactttgggaagctcggaatcttcaagatcaagcttcttttcttgctgcaatggatagcggactttcccgcctataatatgtaaagttaaatagacggcttcttcctcaggaaaccggatggcaaataccggctcaagccgttttaaacaagcccgtgtccattcatattctttcttcttttttactgcgtccagctgtcttgcagaaatcgcgatcggctgcttcattttgatccggcggattgtcagcaatgtatgcagcagcaaactttcaaatgtttcatccgtgaaatagatagaatgggttttttgtaataatttaatttcttttctcacaaaatccgcttcatggcttaagaacttactttttataaattggcttgtaaactccgtattatcagtcaaatccgaaattcgcgccaatgcttttcttttatttttttcgtccccttcaatctttaatccgaggcgctgtttagaaaccagcgtgaggccaaatcgcttcagccacttttcaaccgcatttacatcctttttaatggatgctctgttcacaaagtgctgcgcggctaattcttttgcagaaacaggctttgaattcattaataaatcataagcaatgtgaagtattctttcttcatcggtcttatgcctgcaagtgaaatgctcattatacatttgccggcttaaccatgacctttcctgttctgatatatgtaaatagacgcctaatccgggttttcggatcagctgagcgtgagaatgttcattcaggaaatcctcaatcgttttcaaatcattcctgatcgtcttttcagaacatcggaccctgtctgcgaaatcttgcacaactaagcagtcatcaggttcagataacaacagatacaaaatctctttctgtcttgaattcatgtctttcatctgtttttctatccttcctgtccgtttccgcttgaacaattgtgatagtataaatatactgcgcatacgaaaccgtttacattatatagcggaacaaaagagtaaaaagttttgttttttaccgcagcttccggaaaaatcatgttttatacagtcattggacgacaaaacaccaatcgtttttaaacgattggtgtcggcagtgaaaatctgctgttacagccaaaatgtttctccgagcgctaatgctttcagcttttgcggatgtaacgcaagacgggtccattccctgtgcagtctgcttaatgcttccggtcctgtatcatcagcaagccggaatgctccgtaatgcatgggaatgaagctgtcagccttcagctccaaaaacgctttcacggcgtcttccggattgatatgtgacactttcataaaccattccggttcgtacgctccgatcggcatcagagccgccttaatatgaaacctttctccgatttctttgaaaccatcgaaatagcctgtatctcctgcaaaatagatggattcgccgttttcgctttcaatgacccaccctccccaatgagaggtatcggtatcccagagcgttctccgtgtccagtgctgggccggaacaaatgatatgttcactccccgcacctcaaaacgatcccaccaattcatttcatagacctttttgcagcctttttttaacaacagctttttcagtcccgctggcacgtaaaaatccgggtttcctcgcagtttttttatactcggaaaatcaagatggtcataatgcccgtgtgaaatgagcacggcatcaatatcaggcagttcgctcaactcatatcccggctctgtcagccgtttttgaaaacccatccgccgcgcccatacagggtcggtcatgatgttaagcccctgtgtttggatcagaaatgaggaatggccgatccatgtaatggccgtttccgtgcgattgacggcaacctcgtgaacatccctattggccgctttcggaatgtgctcgcttaaatcttttattttctctcttcgttctttcatccatctcaacatgtccctgaatccattttcattcttcacgccattcaagttttcgtatctttttttcattatcattctcccttgaaacgtgtatttcactggatttatcgggcatttatacaatatctgcaaatgctgcccggcttgcttcggctaaatgttgaggcgctaatttcagctgcattccgattttccccgcactgacaatcataaactccagtgtttcggaggatttatcaataaaagtcggaaaccattttttcatgccgatcggggagcagccgcctcgcatatagccggtcacgcctaaaaggtccttcacggcaatcatttccactttcttctcacccactgcctttgcagcctttttcagatccagttcttttgaaacgggaacaacaaaaacgtaataacgttctgttcctgccgaggccactaaggttttataaacattttcggcagaatatccgattttctccgaaacggaaaggccgtctgcgggctgtcccccttctgttttgtaacctaaaagctcatagggaatgttttgctgttcaatgatacggacagcatttgttttaaccgtttttttcgccatggtgttcctccgttatccgtatttctttctgctttatatcaatagtaacaccagtttcgtcacctcttctactgacacgtatttgcaatgctggattttcagaagaaagatgttacaaaggtagtgaatgatcattcgctcaaaaagaagggattctctttgctgttttaaaaaaagaatgcttttgggaagatcaatgacattcatttggctaacgggccgatacagtttctgtcggtgaaatggaatgtgtacagttgatttatatgtaagcacaaaaacaaaggcagggatgccggctgaagaacttcatcagcagctgtttccctgcaagtatcccattacatttttttcgaagggcaatgggatttaaagcatattgtgacttcgattttacgagactgacggcgcatttcgtgttttgtaatactcaagtgcaaactgtttaaaacgctccgcagccggagagagatcatggttttttaactgggctaacgcaatggtgcgttcgcattggtaatctgccaccggaagaaaaacgaccggaaaatattgatgctccgcggttttcggcagcactgcagctccaaggccggcggcggtcagccctaatatggtcgatacttcctccccttcaaatgcgagatgcgggtgtatattcaaatcccggcacatcagatcaaacatatacctcagcccgtatcccggtttaaatccgacaaaatcctcgtcctgcatttctttcatttgaatgctttttttccctgcaagcgggtgagtttcaggaagcaccgcataaagaggctctttctccagcaccgtccattgtaaaagctcgctgggaagcggcggtgagctgagacagatatccgcatctcccgtttccaccattttgcgaagcgtttcatttgcgccttggtagagcctgaaagtcacgtttggatattgctttttaaattcggcaatcagctgaggcattaagcgcaaaccgagcgtatgaagaaatgatacggatatttcgccgtgctccaggctcatattctttttcacttgttcaacgccttcatttaaagcgcgtctcgcttgttttgcttttagtaagaactgctctccgtgccttgtcagccggactgctttcgtctctctgtaaaataacggcgcgcctaattcttcttcgagcctgataatcgatcggcttaatgccggctgagaaatcatcctttctttggccgcatttgtgaaatgctgatgttttgccgccgcaatgaagttgtcaatttgatgaagctccatttctccttctccccttctttcataacctacacgcattaattccatagttattataaattagacacattgaaatgaaaagcgtacgatacatatataaccaacagtgagaaaagagggacattcatgacgtttatacagcctcatacaaaggcttacagaaaggccagcctggctctgtttatcagcggcttcgtgacattcgccaccctttacacgacacagccgcttttgcctttgttttcggaagagtttcatatttccgctgcggctgcgagcttaactttatccatctcaacagccgttttggcattttcattattggccgccgcttcgttatctgacgatttcggcagaaaaaaattaatggtgctttcattaacagccacttctgttttaggtctgttaacagcattcagtccggcttttccggcgcttttggcgatgaggggtctgctcggtatttttctggcgggcgttccggctgtcgccatgacgtatgtaggcgaggagtttgatccgaagggcctcgggaaaatgatgggcctgtatatcagcggcacaagcatcggaggaatgagcggcaggctgttaacggggcttctgaccgatttattcggctggcggccggcgcttgccatcatcggtattctttctattgtattaagctatttgttttggcgcttgcttccggctccgcgtcattcatctcagcggcatgcgggcttaaaagcggcatgtaaggaatacggagctgtcatacaccgtaaacggctgcttttgttaatttctctggggtttatattaatggggagttttgtcacattatataattatatcggttttcatttaatggccgctccttatcatttgtcgcagactgtgatcggttttatttttattgtctacctcgcgggaacgttcagctcagtctatatggggaaaaaagcggacctttacggaagcgcaaaaatgataaagattgcgatttttgttatgctggccggcgcagcggtgacacttctgcctcagcttgcacttaaaatcgcggggattgccgtctttaccttcgggttcttcggcgcacattcgattgcaagcgcctgggtcggccgcgcagccggtaaccatcgcgcacaagcctcttcattatatctgcttgcatattatatcggttcaagcgtggctggttcttgcggcggtttcttttggacgcattttcattggatcggcatcatttcttttatttcggttttattgctgttgtcttatccggttttatttttggcggaattaaaaaaaagaaaacatagccgcctgcatataaattaataaaaacattaaatgtttgtgtcttttgtccgataataaaaataaggccggcacgatactccctataactattccttttgattcagtagatttcaaatatcgtgccggctttcttccattatatgacggtcatcagttgtgacctcacgcttctgttacacacctgcccacacatctttcgcatatcttccttccgcctgcagctgttcaagccaactcaaggaaactttcgaatcagtgttatgcaccttttcatacgcctgcagcaggacattttccacggccggagccattttgcttccgtcaccgcatatatagagatggccgccttggtcaagaagcgcaataatctgtgcggcctcacgaagcaggacatcctgtacgtatactttacagtcctgatctaaccttgaatacgcccgatgcacggtgacaaggcctgttttctccgcctgatcgaattcatctttgtagagatcatcttcttcaggatgtctgcagccaaagtataaatgagcttcccccaggctgttaccggacattttttcggcagcccgcgcctggataaatcccctgaacggcgcgattccagtgcccgctccgaccataatgagaggcgttttcgtattttcaggcagtgcaaaaccggattgcggtgagcggatgaaacagacggcatgatcgccattctgtaatccggctaagtagttcgaagcaacaccgcgatattctccccggccgctccaagccggagccgttacaacgccgactgtgatactgagttccccgctgtttgccttcggtgagcttgagattgaataatagcgcgcctttaaggacggcaaaagttctaaaaagcgctcgaacggcaattcacatgccggataatcttccagcagatccagcatggtcattcgttttttcagcacgttttctttatatgccgtttcatcagaataaagatgctccaattctttttggtgcggcgggcacacggtatgtgcggcaagttctcgaagctgggctctcgtggccggttcctgcagttctacatatgacgccaaaagctccagtgcattaaccggccggtccatcggcagatgaggtaaatgccgtccgctgattttaaagtgctgattcggatcgagagcgaaccggtgaatgacgcggctgatcagttccccgctgttttgcggaagcaccccgagatggtctccttcctgataagtttctgtttccgggagacgcagctcaatgtgccggactgatcgcgtgctgctttcggtatgaagctctttgtttgtgatgacttccgcctcaaacgctttgtacgttttggcaatcggcgtctcagctgcttcacttacatattctattgatagctgtgatttgttttgctgttcgggagcggcttctatatgaaaagccttgatgatgtcctgccaaaatgaatcttcccaagcttcctgactgtactcaaaatcatcggcattgtcaccctctccgatagaggtaagccgtgttgctcctttttcttcaagcactttgtctataagacggggaatcttctggtaggtggcggcccaattgcggtctccgcagccgaagacggcgtaagaaacaccctttaattcctgatcttcaagagtttccatccacttgacaaaacccgccgcgttatcaggcggcgccccgttgtaagaagccgttacaatcacgacagcgccttttacaggcaatttcccggcataatcatcgagcggcccggtttcagttgaaaagcctttgcttcttccgatgtcagccagctcttccgcaattccttccgcagttcctaaatttgatccgtaaaggatgagaagcggggttccgtgggacggtatttctttcgtttcttctttgtgatcgcttccttcagctttatggttctgtgcggtctgccgattggacacgtccttgtttttcacccggattttaaaatcgccgggcttaatggttaaagcttctttaatcgtaagctcataatcagaatgatcaatcagttcaaaatgcttaaggacaagaccgagcaccatcgtcgcttcctgaagggcaaactgcatcccgatgcaggcgcgctgtccgtttccgaacggcttatacgcatcagccggaatggccgcgggatcactgaacctttcagggcggaataactcggcatcttctccccacgcgcttttatcacggtgcagctgcggagtcagaatcgtcacgggctgtcctttctcaatcggatatttcccgccgagaaccgtatcttccttcgcgtacagagaaaatgccggggcagtcggataaagccgcaatgtttcgtttaacaccatgcggatataggtcagctgctgaatctgcttatattcaggggtttctcccgtcagcacccgttcggcttcctgaacggctttttccaatttatctttatttttcagcaggcagtatatcgcaaaagaaagcagcccgcttgtcgtttcatgcccagcgatcaaaaaggtaataatttgatagcggatattttcatcatccagcctttcacccgttacagggtctttggcttcaagcatcaatgccaaaagatcagacagattctcatccggattttccctccgctcagcaatgatccggtctacaagcgcattcatctcttcaatatcctgctggaactgatgtctcgttttgatcatcagcttgtcctgcaggctgtgccgttgagattggcgcatggcctcctgcagcgcacgaagcatgcttgtgataaaaggatgctgtgtgtcgcggtaaaagctgttaaagcggtaatgaaatccgcacaggccgatggtatccagcgtcaggcgcgtcatatcttcagcgacgtcaatttcttcattcggatttaatctgctccacttctgcacgagctgcatggcaatatcaagcatcattgaatgatagcctttcattgctttctgactgaagctcggcaataaaatccgatgcgctttctgccaattcttttcgtttgtccagctcgtaaataatccgtcaccgccaaattcacggactttcagcaaagctttgccgaggtttttgtcaaatcgcttctcatcacagacttctgctgcgagctcgcggcctgatacgaagaccccgacagagctcgggaattcaaaacgaaagatcgggccgtattcctccgctattttccaaagcgattgtgaaagcttttctttttccaagtgagggagatttttcagagggccgtatgttttcggctgcggtattgcgcttagctgtttcatatagatcttccttccttcggcgaataattaatgagttctgatggcatcccaagagcattgctccaattctttcagaaacggtttcgttatctcgacgcttcccgcccggacaagctgatagagtttaagatatgccccgagcaaaatcgccatcagcacattggacggcaggctgcggagcacgccttcagacttgccgcgctgaaaaaagacgtcaagcatctgtgttaattcatcaagaagcttacggctcgtttcattcagaaagtaggcgtccttattcgtttcaagaaaaaacaatgcatactcgctttcctttgtaaaatcaatcagacaataaaaaagatgatgaaacccttctcttacagatatttttgaaaaatcggttttgacctttttcataaaacgctgggcgctttcctgatacagcacatttacaagtgattctttactgtcaaagtaacggtaaatggtgccggttccgacatccgcctgagcggcaatcatcggaattgtcgtcgcgtcaaatcctctttcggtaaacaaagtaagcgacgctttcataatgagttcaaccttgtttgaagctgtcatccaatcccctttcaaaagcggaatgaatattcattccgtttgttcaaattttaaaatgtacggacatctgataaccattgtataagaaaaaaactttttttaatataaaatatgtgtgaaataaccgaaaataaggaaaaatgcccaatttaacaaaaagagctgcagtgacttaagcagctctttttatttcccgagaaatattctatttaatggcagtaataaaatggaatgaatctctgctgacaactgaaatgtctctgaaatgctgatcacgcagcacctgaatcacatcattttcactcatccgcgaaggcttcaaaacgatgtaaaaacacccgtcaatctgaagaacgcggtacacttctttacatgcaatccggtaatcgctgactgtttcagcagtatgtaaagagaagactttatgaaagctgcggtcgtggaacggaatgctttcaggccgcccctgctgaatgtttccgagcccggccttaatggccgaacggtttgcgcgctgtgttttccgtattttacgtttagatctttctatacttttaagactgcccttttcaagctgtccgatgatttgtttaaacattgagccgtttcctgttccgatttccagaatgcggtcgtattcctgtatatccatcatgatttgtcgaatgaccggttgtgccggttctgatttagcaaagtatttcgcgcgcattcgttttaatgctgaagatgtatgttgcaacattgtataacacccgcttttctattcctgtgatttattattcagaaataatattacctcctattagtacgaggtgctaactagacgcagttctcttcatcaacgtttcgatttatttgaaatttattttagatttcataaaaaaaagacggaaaacgtatgttttccgtctgctctagtaccaataatacggtgcgatatatcttgtctgccgggaaagggccgccattctctgacggcggtacgggttgccgtagccgtgtttaaatgaatggggcattgacgcatacccgtgtccaatggatggaattctattctgaccgccctgcatgctatcacccgcttaccagtttttctttaccatggtatgcaggccgtctgcgccgtgacagaaaaattttcgctaaacctggtccttctccatagtgtaatgattcagcagttcaattctgaacatgatgatctcctccttctcctccattttggctcttcgtgttcattcagttcatataaaaatgtttcagctgacgttctttcgcttcattgtaaaactcttcgacctgttgttctcgttcgtactcttccgcacttttaaaacgctttgaaatggtcagtgttaaaaagaaaagattgatggtcattatcgctcaccccctttcaatatccgcacaagcgaaaataacccgcagcaaacttcagatgcgctgcgggcagactaaatccgcagacaaaagaagccgatgcttctttccctgcggggagctgcgaatgtcctgatactccgaaattaacgtgcttgacaggcagaggttaaggaaggacacgaactcttccacaggctgaatcgattcaattttggattttgcttaccgtttaacattgtcatgtgactcaacctccctttgcttttttcttactttgtaagtatatccaccgacttccaatttgtaaacatttttttcaagatttggacggaaaatgtgcttgaattccgctataattgtccatgttttccggcatctttcttacctcaggacactcttttcattccttgtttattctgatccttttttgaatatgcaataaaataaataaggccgacaaacactgcgccgccgatcacattcccgataaaggccggaatgagattaagaatcagatccccccatgaaaaagagcctgcaaaaattgcggccggaatgataaacatattcgcgacaacgtgctgaaaaccaattgcgacaaacgccattatcggaaaccatatacccgcgattttaccggctccgtcttctgcgccgaaagaaagccaaacggctaaacagacaagccagttgcagccaatcgccgaaacaatgacttttccaaacggcatatccaatttgccttgtgcgactgcaatcgttttttccaaatacgggcctgtttcggttaatccgactatatgtccgaaaaagtaagcgacaaacagcgcgccgacaagattcatcagcgtcacgatgacccagtttttcactaatgaaccggctgatattcttctggaaaacagcgccatggatactgacatcatatttcccgtaatcagctccgccccggcaagaacgacgagcaccagtccgacaggaaacacggccgcgccgattaaactcgacaaactgccccattctttcggaagatctccgatgacacgaatatcaagcaaataaccgagcgcgataaacgctcctcccaaaaatcctagtacaaccaatgctgaaagcggtgaatgcactttttttacccctgcttcgaccgcaagctccgctatttcgtccggtttacgaaacgccataataacccctccatttatcaattcatccggcagtttcaaaaggcgcccaacaaaaaaggcagcattcaaataacccgtctgaaaacggggattgaatgctgcctaacttgtatgcatacccatacaacaatatcaagcagaataaaaatatgcgttatagaacatgtacagatcatgcacacattccataaaaaatcgtcctttagccactgctggcagttcatatcatatcaaatgtgacaatttcgtgtcaattaaatattatcagttcttgatttcttctttatgctcctcaatggagcggtcaaatacaaacacggatacagcaatattttcctctattttaatatctgaaaacaggtgcacgagctttgctccgataagctcttccattccgtcaggcgtttgttttgaatacagctcctgaattaagctggtccgcgcggcgtgaaccatttcccttccttcaggcgtgcgtgcgataaactgctcacttgcgcttaaattgccgtaaagcgtagataccgccatgttatctacaaagacggtgtgaattcgttccggcccttttccaaataattctttgcgcaatttccggataatatcgttaaattcatgaatctttttagacatattgtccccctccgattttagcctatgaaagacattcccggttcccctttgtgacatttcacctggttaaagttttcctttcgtattgtattataataaatatcaccttataataaaagcagtgaagatggattcgtaataggaaacgtgttatgagtctatcgttttatacagataggattggtctgttagtaagacttgctagtgaactattccgccatgcgtatttttaccgatctccggacaggaggccggtatctatgtgcatggcttttttcgagtttaaaagatggaggggaattggaagtgacagacgttcagtctatccgtgtcaaaattgacggcacagagtatgaagcaccagaggggactaagattttagatattttaaatcaaaacggaattgagattccgcaaatatgccatgtacctgaagtagatccgattcaaacatgtgacacctgtattgttgaagtaaacgggaaattgcagcgctcttgttttacggctgcagaaaatggaatgtccatctcgcttacatcaggtagggtaaaagaagctcagacggaggccatggaccgcctgctcgagaatcacctgctttactgtacggtatgcgataacaacaacggaaactgcacactgcataatacagcggaaatgatggggattgagcatcagaaatatccgtatacgccgaaagacgattcaaagtgcgcggttgatatgtctcatccgttttaccgctatgatccgaaccaatgcatcgcctgcggccaatgtgttgaagtgtgccaaaaccttcaggtgaatgaaactctttcaattgattgggagcgcgaccgcccgcgggtcatttgggacgaaggcgtcgccattaatgaatcttcctgcgtcagctgcggccagtgtgtcactgtctgcccttgtaacgcactgatggaaaaatcaatgctcggccaagccggttttatgacaggaatcaaagaagatgtcatggaaccgatgattgatttagtgaaaaatgttgaacccgactacacaagcatcttcgccgtgtcagaagtagaagcggcaatgcgcgataaacggacgagaaaaacaaaaaccgtctgcacgttctgcggcgtcggctgctcttttgaagtatggacaaaaggacgtgacatccttaaaattcagcctgtttccgatgctccggttaacgcgatttccacttgtgtgaaagggaaattcggctgggacttcgtgaattcggaagaacggattacaaaaccgctcatccggaaaaacggcgcattcgttgaatcgtcatgggaagaggctcttgaccttgtcgcttcaagactcggctcgatcaaggctgagcatggtaacggttctgtcggttttatttcttcttctaaaattacgaatgaagacaactatgtcatccaaaaattagcgcgccaagtatttgaaaccaacaacgtggataactgttcacgctactgccagtcaccggcaacggacggcttattccgcaccgtcggtatgggcggtgacgccggcacaattaaagatatcgcaaaagcgggcctcgtgctcatcgtcggcgccaatccggcggaaggacacccggttctcgccacacgcgtgaaacgcgcgcataagctgcacggacaaaaattaattgttgccgatctgcgcagaaatgaaatggctgaacggtccgacctctttatcagcccgaaacaagggactgaccaggtctggctcatggcagtgacgaaatatatgattgaccaaggctggcatgaccaagcgtttattgatgaaaacgtgaattactttgatgattataaagaaacgctgaaaaaatatacattagaatacgcggagcgaatcaccggactttctcaagatacgatcatccgcattgccgaaatgatccgtgatgcagacggcacttgtgttctttggggtatgggcgttacccaaaatacaggcgggtctgatacatcagcggcgatttccaacctgctgcttgccacagggaactaccgccgcccgggtgccggagcttatccgctgcggggacataacaacgttcaaggcgcttgcgatatgggaactttgccgggctggcttccgggatatcagcatattaccgatgatgcggcacgggctaaattcgaaaaagcttacggtgtcgaaattgacggcaagccgggccttgataatattgaaatgctccatgcgattgaagaaggaagcatgaaagccatgtatcttgtcggtgaagacatggcgctcgtcgattcaaacgccaaccatgttcatgacattttatccagccttgatttctttgttgtgcaggatattttcctttcaagaacggcgcaatacgcggatgtcatcctgcctgcggttccatctcttgaaaaagacggaacatttacaaacacagagcggcgtgtgcaaagattgtatcaggcgcttccgacacttggcgatgcaaaacccgactggtggattattcaggaagtagccaatcgtttaggcgctgattggaattacacgcacccaagcgatattttctcagaaatggcgagcctttctccgcttttcggaaaagcaagctacgacgttcttagcggctggaacagcttcctatggggaagctttacgggagaaagcactccgcttctttatgaagacggctttaacttccctgacaaaaaggcccgttttgcgctgagcgactgggtggagcctgccgtattccctgaagaatatgacctgcacattaacaacgggcggatgcttgaacatttccacgaaggaaatatgacaaacaaatcgaaaggcatacagtctaaagtgcctgacgtatttgttgaagtatcgccggagctcgcagctgaacgaggaatttgcgacggaacaatgatccgtcttgtctctccttttggagcggttaaattaaacgcgcttgtaacagaccgagtccgtgcaaacgaactttatctgccgatgaactctacagataaagattcggcgattaatttcctgaccgggcccgcgtatgattcacggacacatacgcctgcctataagcagacaaaagtccgcatggaagtgctcggttcctgtgatactccgccgcttccgaaaacgaatccgcggaacaaaaaacgccacccgcaaaacggtgtggaagcgcagcgaaaatggaaccgtccgggctatgtgcacttaactgattaaggaaaggaggaagcattatggcaagcccaattactgaaattcataaagaaacaaaaacagaggaacagctgaaagccgaaaagctggaagagctgaagacgcttcttgcagaaaatgaagaagccgtcgcgaaaacgatgtctattatggcagagctgaatggcttggggatttttgatgccgccggctatatgctccaggcgaaagaggaaattgccaaaatcgcactcggacagatttcccgggaacctgtcacaaatcttctgaatacgatgatggccgcgggaggcgcgctgtcaaaagccgatcccgaatttatgggcagacttttagagagcgtcatggccggaacggatcaggcgcaaagctttttaaaagaagaccggaaagtcagtatgtttgaactgatgaaagccgccggtgaccctgatattaaccgcgcgctcggcttcgggctgcagtttttaaaaggaatgggaaaagaattacgaaaaactccaactgaataagaaacgaaaaaagccattgtcaaaagacaatggctttttttattcatcggcctcgtccagcctctttttataaataagtgaacggtcaacgcagaaataagcgcccgctaaaaatacacaatcggttacaaacatcagcattttctggcctgcagtcagcccttgtccgggaagaaccgcgccgatataaatgaaggtgctgactgcaagcagaataaatgcgtaatgcttaaaatcttctattaatgatttcagtcttttcttctccatataaggtcacctgccagttttatagtctaacaacattataatataagctgacagccgacagagaatgtaaatctatccaatctttataaaagtgaatcaagcgcctgtttcacatccgccgttaaatcctcagtgtcctcaataccgactgagatccgtacgagcccgtccgtaatgccgagtgcaagccggcggtcgcgcggaatcgaagcgtgtgtcattctggacggcacggagattaggctttcaaccgctcctaagctttccgcgatcgtaaacaggttcaatttttctaaaaatgcgtcgacacgttcgctgctgccgatatcaaaggaaatcattccgccgaaaccggagctttgcgcttttgtcagctcatggcccgggtgtttcggtgatcccggatagtagagcgtctgaacggcatcatgcgcttcaagcagctcggcgatctttccggcgctgtgattgatggcgtccattctgagtccaagcgttttaatccctctcatcaacagccatgaatcctgcggtcctaaaacgccgcccgttgagttttgcacataatgaagcttttcgccgagctctttatcagccgttacgactaagccgccgacgacatcactgtggccgccaagatattttgtcgcactgtgcagcacgatgtcagcgccgaagctgagcggctgctggaaatacggcgtataaaacgtattgtcgacaatgagcaatacgcccgcttcttttgcgatgtcagacatcaatttgagatcagtcactttcaaaagcggatttgtcggtgtttcgatataaatggctttcgtattcggacggatggctttttggactttttctttactgctcgtatccacaaaatccgcttcaatgccgaaacggttcagcacacctgtcatcacccggtaagtgccgccgtatacatcgtccgtcaaaataacatgatccccgctgtcaaacagcatcatgacggccgtaatcgcagccattcctgagccgaacgcatatcccgccgcgccgccttcaagctctgtaattaaactttcaagagccgtccgcgtcggattggccgttcttgagtattcatagcccgtgtgctcgcccgctttcggctgctggtatgtgcttacttgataaatcggtacggaaaccgctccggttttttcatctcccgtaattcctccgtgcaccatcagcgtttttttcttcatcttactgacctccttggaaaatattcttgcttatataacgatcgctgccatcagggaaaatagtgacgatatttgacccggcgggcgcttttttcgcttcctcaagcgccgcatacagagccgcccctgatgagctgccgattaagagcccttctttttcggccgcttctctgacgaacgaaaatgccttatcgtcctctactgtataaatggcgtcaaaatggctctcgtccatataatccgggataaactccatgccgatgccttctgttttatgggcatgcggttctccgccgttcaggatggagccttccggttcaacgataaccgttttgacggcaggatttttttcttttaaataagctgccgtgccggcaaaggtgccgccagaacccgctccggcgacaaaagcgtggatattgccgccgagtgcgttccatatttcaggtccgagcgttttatagtaagtcaatggatttactcggtttttaaattgcaaaacagcataagaattactgatttctctctccagctcaagcgcttttcggatggctccctgcatgccttcttctctcggcgtgtgcacgatgtcagctccgagtgctttcataatctgctgcttttccctgctgaaatgctccgggacgcaaaaaacggcgcgaagctgatgctttctggcgcacagagcgagtccgattccggtgtttccggcagtcgcttcaatgataacgccgcccgcttttacttttcccgtgcgaagcgcatcctcaatgagcatctcgcccagcctgtctttaatgcttccgcccggattcatcatctcaagcttagcataaaccgccgttccctccggtatatcaaaatgcttgaggcgaagcagcggtgtatttccgatcagctctgtaatgtctgttatcacgttcaacatacgtcctccccctgaaagcgggggagaacgagaatcccccgcttagtgaattcgtttgatgacattcaggacaagctcagttgaatgaacggcagcctgttctaaaaatttatcaaatgaaacgtcagattcttttccggcaatgtcagataaagctctgatgacaacaaaaggcgttttgaactggtggcacacctgtgcgacagccgccgcctccatctcaaccgcgtacaaatccgcaaacttggcgcgcacgtcttcaacccgcttcggatcattcataaaagaatctcccgttgcaattgtgcctttggcgacttgaatgccgttcagctcagaaaccgcttcctcagtaatgctgatcagcttttcatcagctttgtatgctgccggaagaccgggcacctgtccgtattcatagtcaaacgccgtcacatccacgtcatggtggctgacatctgttgagatgacgacgtcgcctacattcaatgtatgatgaaatccgcccgctgagcctgtgttaatcacataatcaggtttgaaacggtcaagcagaagcgtcgtgctgatcgccgcgttgacttttccgatgcctgatttgagcaatataacttcgacgccttcatagctgcccgtcgtaaactcacagtgcgcgatcatctcttgttttgcgtctttcagtttgcttcttaaaatcgtaacttcctcttccattgctccgatgactgccagtttcatttatacacaatcccttcgatttaccgtttaatcgcctccattatccagacaaagtcattttgctgcgtaaatcgcgcggcaaacccctcagttgaaaagatgtttttcattgtcccgagtgtcggataatgttccgtctttaaatcgtccgctaattgatgatagccgtttcggcttgctttttttatagcttcatcgtatgcttcttgatctttaaagacggtatcggcaaacactattttatcatgcttctgaagaattgtgccatactgctttacagccgtttgcttttcttcatcggttaaatgatgaaaggcgtacgagctgacgatggtatctatttgaaaaggcggagcgggaaactccagaaaatccccgtcactgaacacggctctgtcagaaagcttgtcagctgccagttttctcattgacggagacggttctacaccaaacaccttttttttcgcggcggctaatttcgccgtcaaattcccagtgcccggtccgaactctaaaacgtttgaacctgaaagtgcgacgatgctgtccagaatattgtcatatcctttaaaaacatcggcatattgtttgtcagccccgtgcaccgtggcgtcataagtcgctgcccaatcttcgaataaaggaataaattcacggcccatatttttcactctccataatttataattcctatgagtatagtatggattaatcgtggaacagttcctatcctatcacaaaaaagaacgaaagggtactaaaatactctgggattattgcgcaattacggcagaaaggcttatactttcattgactcagaagaaaaatcaggaggatctgtactgatgaactttcaattggatttaataaaagataaagtagaatttttcgaagcggcatctttgcaggagcttgaaaagaaaataaacgttcaggttgaaaacaaccaggcgattatgcttcgcgtccgttctgtatctcatcaggtgacggccgttgacggcagaatcctttacagcgcgtcggtgcatttttccgctgacgtatgacagaaaaaagcagctgactcttcagctgcttttttgcggttattttaatgtttctacttttgtcggcttccagccttttttgtcttgccaagtgatggtaacctgatactttttgccgttcgttttgtctaaaattttacccttcgcatcttgcgggcttccattgtttccgagccacagcactgtcatgtgatcttttgacacgccggttgcgtaagagatggcgtcgagcatttcagaccagtcttcagagcttgaatcatacgtcgccgtatgttctcccgtctgctttgtgccgaccgctttccattttgagttaacaattgttttatcgacattgctggatgagccgccctctgttatttctgctcctttaaaaggatcgcttgaatcagagtcttttttgctgctgtcatcacttttagatgaatcatcatcttttttgctgtcagagtctgaagatgaatcagatgtgttcttatcctgtttatcttttttgtcatcgtctgacgccgtatcttttttgctgtcttttatgtcttcatctgatgtctgcttcgtcttgcctgatgcaggtgtttcctgcttttggctcgtgtccgctttttcgctcacgtcgctggacgggctgttgatgaagaggctgactgcaacgacgacaataagaatagatacgatagcaattaaaatgttaagcaccatatttgcttttctgcgcttatcacggttttcaaaacgagattgtttattgctcaatcattctgcactcctttatccctcttgctcagcatatattttaacatgggctgagcggttgttctatgtctagtttgtttcattttcatgtacctttttaacaatatcataaaacactgtatttgtcagagccttatcccccggcgtgtccatgtgcagcaccacgagagcgtatttcggcttgtccgcgggaaagtatcccgcaaaccatttgtggtaaagcgtctgtttttcttgtgtgaacattcccgtctgggccgttccggatttgcccgccaccgcatacggcagatcctgaaatctcctgccggttcctttcggtgaagtaacgacttctctgagaattttttgaagctgctgcgccgtatatttatcgatgcttttccccttcagcggctgatctttgaatgacgccatcgtcgttccatttttgtattcgattttgtctgcgattttgacttgttttttttcaccgccgcgtgcgatcgttgccatcatattggcgacttcaagaggcgtgactttcacgtttttctgcccgatcgccgtctgtgcgactgctctttttacggttttgtctttggcatctccccaaatgacgccgcttttttcattatacaattgcctgaatccgtcttcccggtacagcttgccttcccagcccgcccgctgtgtgagaccgagcttctccgccatgttttcaataacggagtcatcttttttgaccaatttttccgcaagacttgtaaacgtataattgcagctttgggcaaagctctctccaaaactgagcgtgcctttgtcgtcacccggctctccgtacaggttgagactgcagttaaaggaagtgctcggcttcacttcattttgttcaattgcggctgcggcgatcaccgttttaaacactgatcccggatatatcggcgtcagcatgtaattttgcagagtctgctgctttgacatgtcggcgtcaggctttgataccataccgagcacactgcttttttcaatgtctaaaaggacggctccccccttttttaacccgcggtctttcaatacatcttccattgctttttgaatattgcggtcgatggaggttttgacttgcagcggataaaacgcgtttgcttcagccgtatatttgacgtccattccgaataaagggtttccccttccgtcgacatgatacaaaagttttgtgtcctgatccgctagtaaaaactcatcaaacgtccgctccatcccgcttgtcccgatttttgccgtgatcggcagttccttgcggccggggtatttctttttcaaaagctccgggtcctggtttgtcgcgcccagcagatgggcggctatgtttgtttctttgctgtctttcatatatacgccgtaaatgccgggatatttcaaagaattgatatttgatacggattgtttcgtcagatgtttgatttttttgctgtttaggatcaccggttttttcgcctccgtgagcagctgcctgagctcctcctgtttcattccgagaatggcggatacccggtcaaccggccaatcctgagtcacgagaaagggaaacagaacgacggccggctgcttttttccggtcagctcttcgccgttccgatcaagaaaagagccgcgtccgtctgaaataaggacttcttcagtccgctgcttgacgctttcctgaatcagattaatattagattttgaaaaagattctgtaaaaaacagctgaatttcagcaagtctggcaagcagaaagaaaaatacgagcagaaaacaaataacggccgctttcagcctttttgatacgatcataaaaaacacctcatccacattttggacgaggtgtttcattgttaaacggatcttatgaaattttcacaattttcacgagcatttctccgcccggcgtctgaactgtgacttcttcgtccacttttctgccgagcaggcttttggcgattggcgagtcgtttgaaattttcccttcaaacggatcagcttcagcgcttccgacaatcgtgtaagattcttcttcaccgtcaggcaattcgatgaatgatacggtttttcccaaaccgacaacatttgaaccgccgtcgtcctcgatgattttcgcattgcggatcatgttttcaagcgtcgtgatacgcccttccacaaatgcctgttcttcttttgcagaatcatactcagagttctctgacagatccccgaagcttcgtgcgattttaatgcgttctactacttctttacgtttaaccgttttcaattgctctaattcttgttcaagtttttgttttccttcttgagtcatcggaaaaactttttcttgtgccatgttccttcactccttggtggttgtccctcaacaataacgtgtgattatgtatgagagcataaacgaaaaaatcaagaatgagaacacagggcagtcctcgttcttctctcccatataggtactgtttatcttaaactgaatgtgtgttttctgcaaatgtttcggtttataaacagggaaagaagggaactgtctcattcccttccagcctatacataatatggtctgagttatttatgtctatgctatggtattacaaaattgcattttgttcaaggatcgtttgaatcttcgtgaccatcagatcgatagcgacgtgattttggccgccttccggaataatgatgtccgcgtagcgtttcgtcggctcaacaaactgattatgcatcggcctcacgacggagacatactgctcgatgacagaatcaatagaacggcctctttcgttaatatctctcataatccgtctgatgatacggagatccgcgtccgtgtcgacataaagtttcatatccatgaggtcgcgaagccttttatcttcaagaacgagaatgccttcaagaataatgacatccttcggctcgaccggaatggtttcctcagaacgcgtatgcagtttataatcataaatcggcttttctatcggccgataattcaaaagctcttgaatatgctcgattaaatagtcattatcaaatgcgagcggatgatcgtagtttgtgttcagcctttcttcaaacggaagatggctttggtctttataataaaggtcttgctggatcattaaaatcgagtgtcctttaaactgttcgtagatggaacgtgtgacgcttgtttttcctgatccggaacctcctgcgatgcctataactacaggactcttacccattggtgattacttcccctttctcatcatgttgctcggataaatctttttgtctaccttaaatgtaacgatttgcaggggatggcgggcagcatcaagctcgtttccgtcttcgtcccaaatagtgccgatggtgaatgtgaaattatcgatttcgggaccgaaaaattccacttcgtcaccttgtttaaagaaattgcgctgctggagcgtcaccatttgagtttcctcgttatatgcgagcacgagaccggcaaaatcaaatgttgttttctttccgtgttcgccgaacatctgctcttcaaaaccgggcgtgccttcaaagaaagcaggcgcagtatcccggtttgcacatttgtccagctcatcaagccattctttttgaatgacaaagttttcaggatcagcgcagtatgcgtcgatgactttgcgatacacgctgacaaccgtcgccacgtaatgaatcgatttcatccggccttcaattttcaggctgtcgatgcccatctcgatcatttgcggaatggattcaatcaattttaaatctttcgggctcatcgcaaatggagcgtcgtcttcgccgtagagcgcgaccgcgttcgcaccgtctgtctgatacaggtcataatcccagcggcaggactgacagcagccgccgcggttggaatcacgggccgtcatgtgattgctcagcacgcatcggccagaataagcgatacacatggctccatggataaaggtttcgatttcaatatccaccttttccttcatttctttaatttccagtccgctcgtttcgcgggcaagcaccacgcggtcaagcccttcttctttccagaactgcaccgctttccagtttgaaagggactgctgggtgctgagatgaatttccacatccggggccactctccggcatgtttcaataatcagcggatcagcgacgataattccggcaactttcgcgtctcccaacgcttttaagtattcttccagaccgtccatgttttcattatgggcaaaaatgtttgttgtcacatatattttcgccccgtattttttggcaaattctacgccctctgcgatttcttctatagagaagttatccgcatttgagcggagtccgtattcctgtcctccgataaaaaccgcgtccgctccgtaatgaacggcaatttttaatttttcaaggtttcctgccggagcaaggagttcaggttttttcgtaatgacgcgttttccgtttacgactttggaaatggtttgatttacggctgtcatccgttgcatcctcctttttaatagaccgtttctttaaagaagaatcctgtgtcgatgcttctgttcacaggctgaatgctttcaatccgttctatccagctctcttttttctcttcatatgtctcccggctgccgaagcacagatcgattgcttctctgtacatgcgggttacttcaattaagtattcaggagacttcaagactccgtcgattttgaaagaatcaatgccggcttccatcagatcctctaactcatcaatcatgcacacatcgttcgggctcatgatgtgcgtgccgttttcgtcttcaaaaatcgggtatttattgccccgttccttgtcatgcagaaacatgcccgcttcttttttcttctgttcgatgtccatgacttttccttggtattcgaagtaatggcccactaacgaacgcttggattggaacatgcaggtcataccgtggatttgaatttcaatttccacttcggcgttttcttttatgtcaatgatgctgtccatatttaattccttagccagcactgcacgccgtgcgcctttgcgtccccagtaattgcaggaatagtagttggttcccgttgtttccgtgctccagtggagtttgagcccgggagccgcttcccgcgccgccattaaaacggccgggtcgccgaaaacagccgcatcaacgccggcttcctgcaaaaaggcaagatagccgttcagctcgtccactttttcattgtgaaaaatagcattgacagcagcgtacactttcgcaccttcttggtgagctgtctttacggcttcttttatatcttctcttgaaaattctccggccagtctcaggccgtatctttgttctccgactaacagcgccgttgcgcccgcttgaatgagcggaagaatatcctgtacggaagtcggagtcaccaaaagttcaggttttttcatgatcattcacctcttctttttactgatggcgatgccgtctccgaccggcagtataaccgtttgatagtcagagcggttcatcagccattggttatattgatcaattttttcaacaagcttccgttttcttttcggctcaatttccgagtgatcttgtgccaccagtcctttaaacaggacgttgtccgtgaaaatgacgccatccggcgcaagcatcggttcatagagctcaaaaaagttcgtgtactggcctttggccgcatcgataaaaatggcatcataaggagccgtgacacgaactgactcagaaagtgtcagcgcatccccgtacagtacgtgaatccgattttccatttcaaagtcttttatattgttcacagcttcttcatagcgtttgtcgtcccgttcaatcgtgtaaatattcgcatccggaagctcaagcgccatccgtatggcggaatacccgattgccgtgccgatttccaatatgtttttcgcctgttgaatcgacagcatttgaagcagcacttcaatgcccgcttcttccataatcggaacatggtgctcttttgcataggcttcaagctttttcactttatcaggccgaggcttcagcatcgcgtttatatactcgtttatttgttcataccgatcattcacggcaaacagcctccgttctaaaaaggagtgcccctgacgaatccgcggggacactctcttaagacacttctttattcataagtaaacaacccgatatattttatcataaaacctttcagaatggaataaaaggagagcttttgccccccttttattcactgtcttttttggaaatatacttttccttcgctttattatgatcttttaatgttttcgtgaaaacgacctcgccgtttgattttgccaggaaatagagataatccgttttgtcaggattgagagccgcttcccatgatgaatccccggcatttgcaatcggtcccggcggcagccccttattcttatacgtattatacggagaatcaattttcaggtctttgtagtagacacggcttttatgcttgccggccgcatataaaaccgtcgggtcagtctgcagcggcattttttctgcaagcctattgtaaaaaacgcttgcgattttgtgacggtcggctttggcggtggcttcctcttcgataagcgatgccatcgtcagagcgttatggacggaaagtttctttttttccagttctgatttataggtttcaatacgggtgtttgtttcctgaaccattgccgtcaaaatcttgtcaagcgatgcatccggatcattaaacggatatgtagccggatacagatagccttcaagcggatgcttaagcttcttgtttgaaagagcgtccgttatcgtatcaggaaacttgtttttcagtttgttaataaatgttttgtcgtccagtttcgccatgatctcttcttttgaatatgatgtttcgtttgcgatcgcatcagcaatctgtgtaagctgttttccttcaggaacggtgatctgaaaggcatatcccgcagatcccgcggtcagttttttaataatcgcatccgcgtccattcctttattcagatggtaaaatccggcctgaaatccggaagcgcctttatacttcacatacagctgaaatgcttttttgcttttgatgacatgctgatcctcaagaatctcagcgattgccgaaaccgaagaaccgcttggaatattaatgttgactgtcgttttgctgccttcgtcaaccggagacagcagtgattttccatagaaaaaagcaccgcaaatgatgataaaaagagcgatcacggaggacagtattatcgtcgtttttttgtttttacgcagaaatgaatttttagtctgattgatagtcatacaagtattttcctcccaacagctcttatactacatgattcatgcgcattcggcaatttattacaaaaaaagccgaagcggcatatgcgctccggcttttttgttcattttattcttcgtcttcttccgctaaaaacgtgttcagcgtttcttcgatcatttcccactcttcatcagtttcaatcggcatcagttcgccgtcttcaccgttttcattcggctcgaagcttgaagcgtgaatttcgatttcatcatcgtcctgagcatcaatcggataataaagtacgtaagatttgttgaatgtgtcgttttcaaatgtgaacagcacttcgcaaagctgttcgttgccttgatcatcgacaatcgtaatgtgtttttcgccgtgttccatttctttcacctcttagtttagactgtccagaaacccttgaagtatcatgacagccgccattttatcaatgactttttttcgtttttgcctgctgacgtcagccgcgatcagcattttttcagccgccatcgtcgtcagacgctcgtcccacagcacaacagggacattgtacgctgtttcaagcagtttcgcaaatgtttggctggcttcgcctctcggaccgatcgtcccgttcatgtttttcggaaaaccgagtacgatcttctctacattatagtctttcatcagctcggataaacggtccagaccgtaatctccttcagcctcgtttatttttatcgtctcaatgccctgagcggtccagcccatttcatcgcttaaagctacgccgagtgtcttcgttcccagatcaagtcccaatattctcatgaatgtatttacgcctctttatgctgttctagataggattttaccaattcctcaattaattcgtcacgttccaatttgcgaattaagttccgggcgtcgcgatgcctaggaatgtatgcaggatctcctgacagcaagtatccgacaatctggttgataggattgtatcctttttcctgaagcgcatcatacaccgtaatcagcacttcttcgacgtttgtttcagcagaatcatcggagaaattaaatttcatcgttttatcaaacgagctcaccgttttgcacctctttcccaaattcgcaggcaaagttcagcctgaggtcctcatcttatcatcattctacactagttgaaaggattataaaacggattttatccaatcttccgcagaagtgagcgcctcttccaatttctcaggctgctttccgccggcctgcgccatgtccggacggcctccgcctccgcctccgcagacttcagccgcttgtttgaccattttgccggcgtgaaggcctttttcgatcaggtcttttgttacgcctgctgacaggttgactttgtcattttgcacggcaccgagaatgataaccgcagaaccgagcttcgccttcaggtcatccaccattgtgcgaaggtggttcatgtctttcgcgttcactttttcagccagcacttttacaccgccgatgtcttttactttagacagaatggctccggcttccacattgccgagtttgcttagcaatgattcattttctcgttgcgcttctttcagctccgcttgaagagactggatccgcttcggcacgtcttttacgtttgttttcagctcatccgcagcatgctgcaaaaggctgagctggctgttcatttcctgatacgcgccttttcctgttacggcttcgattcttcgcgtacctgcgccgatccctgattcggatacgattttaaacaggccgatttcagccgtattcgtgacatggcatccgccgcaaagctcaaggctgtaatcgccgacttgtacgacacggacgatatcgccgtatttctcgccgaacagagccattgcgcccatttcttttgcttcattgatcggttttaagtcaatcgccaccggaatgctcgcccagatcttttcgttgacgattccttcaatgcgctcaagttcctctttagtcacttggccgaagtgagagaagtcaaaacgaagacgattttcggtaacaagtgaacccgcttggttgacatgtgtgccgagaacgtctttcagcgcctggtgcaaaaggtgggttgccgtgtggtttttcaccacgccgcttctcatttgatcctctacttcagccgtcacgcttgcccctttttgaatcgtgccgctatccactgtgccctcgtgtacatgctggccgttcggagcttttttcacatctttaatggttacgacagcctgcgcgcttctcagcacccctctgtcaccgatctgtccgccgctttcagcatagaaaggcgtctcatcaagaagaatctgaacggtatccccttcatgagcctcgctgattaattgtccgtcatgaagaagctcgatcaccttggcttcagcttttgtggcactgtagccgacaaacgtgctttctgcggtaatgtcgcgtaatgcgccgccctgcacctgcatgcttcctacatcttggcgcgcatttctcgcccgttcacgctgtttctccatttcggcttcaaagcctttatggtcaaccttcatttgttcatcttccgcgtattcctccgtcaattcaactgggaatccgtacgtatcgtacagtttgaatacgtcttttccggagatgatgccgctgccgttttctttctctttctttatcacgtcagataaaatcgccaaaccttcgttcaatgtttcatggaagcgctcttcctccgttttgatgactttggcgataaactcttgcttttcttttacctccggataaaaagcgtccataattcctgcaacggtcggtactaactcgtacataaacggacggctgataccgattgttttcgcgtatcgcacagcccggcgcaagaggcgtctcagtacatacccgcgcccttcgtttgacggcagcgctccgtcgcttaccgcaaatgcgaccgttctgatatgatcggcaatcactttaaaggccgtatccttcaccgcatcctttccgtaagcatctccggaaatgcgctctgccgcttcaataatcggcataaacaaatcagtgtcaaagtttgtcggaacattctggataacggagaccatccgttcaagccccatgcccgtatcaatgtttttcttcggaagcggtgtgtacgtgccgtccggattgtggttaaactctgagaataccaggttccacacttcaagataacggtcattttcgccgcccggatacaattcagaatctgacgggtcattgccgtatttctcgccgcggtcatagaaaatttccgtattcggtccgctcgggccttcgccgatatcccagaagttcccttccagacggatgattctttcttccgggacgccgattttttccgcccataacgtataggcttcttcatcctccgggtgaaccgttacggacaggagctccggatcaaagccgatccacttttcgctcgttaaaaactcccatgcccacgtgatcgcttcttctttaaaataatcaccgatggaaaagtttccgagcatctcaaagaacgtatggtggcgcgccgttttccccacattttcaatgtcatttgtgcggattgatttttgcgcgtttacaattctcggattctccggcacaacgcgcccgtcaaagtattttttcagcgtcgcaacgccgctgttgatccacaataaagacggatcttcatgcggaaccaatgaagcgctcggttcaacagcatggcctttttctttaaagaaatctaaaaacatttgacgcacttcagcagatgttaagtgtttcatctatattcctccttatcactacccgaaattctcttttgcgacagcaaaaaagctctctccctatgcaaaccatgcgttcacacagggacgagagctgtctcgcggtaccaccctgattacaggccgaaaaagacccgtcacctttcatcccgtaacgcaggactgcggcagcctttaactgcactcaggattagcttcggccaatcttctgctgaagctcctttcagcgtatcggagcttctctcttaaacagggcttcggcgtactcatatccgtcactcgagattcgtatgtattctactcgaaattatagacaagcagaacccgaatgtcaatgttccgtcctgatccgcaaaaagtgaatggccgtcacttttaaaacggctgctgccggaacggcgagaatcatgccgggaatccccgcaagctctcctccggcaagaagtgcaagcataatcacgacgggatgcattctgaggcttcgcccgacaatgagcggactcaaaatattcccttctataaattgaagaataaaaatcgtgataatcacgatgatcacagcctttgcagaaagcgccagcgcaaggagcagcgtcggaacagcgccgataaacggaccgaaatacggtatgacattcgtaatgccgatgacaaggcccaagatcagcggataaggaaggccgaacatccaaaaagaacagcctgctattaacccgagcaaaaaacaaacgagaagctgtccgcggatgtaatctccgagggaatcgtccacatcccgcagaaattcactccccctttttctccaggacttcggcgtcaaataccagaccgtctttttcatggcgtctatatccttcaccatatagaaaacgagaaaaggaatcgtcgccgcaatcaggatataatcaaacacgaaacggatgcttctgatcgtgctctcaatcgttccggcaaggaacgtttctgtctgctgaatcattttgtccatccggtggtgcatgccgtcaggccaatgatccgtatgattgtgcagatgcctcagcatgctgttgtagttttcagcaagcccgggaatgctctcagacagatcctgcagctgttcaattaaaacaggaactcctttataaaccccccagccgattccgccgaaaaacaggaaataaatcagaagcaggcttaaagttctaggcatccctttcccatgaagccattcagtaatcggaagtaaaagataagcaataaatactgcgatgaatataggaataaagagagattttataacaagccatatgggtgcccataacatatcgagcatacaaaagacatacactgttaacaaaacgagcagacatacagccgtccacattaagagctgcagcggtttttgaagcatgacgtttcacctcttgctttatcttttgacagaaagccggaattattcccgtttcataaagtccgccttatgacgcagatctcttgacggaaataattatctgaaattacaaaaaagtttgaatataaatcataaaaatctgaataattatcatagcatgaagttaattcgaaaacttattagtctatatgacatgtttttcttaggaggattgccatgatctcatttcaggatgtaaataagcattacggacattttcacgtgctgaagaacattaatctgcacattaaaaaaggggaagtcgtcgttatcatcggaccttcaggatcgggaaaaagcacgcttctccgctgcatcaatcagctggaaacggttgatgaaggcgccttgacggtaaatggcgccgacatccatgacaagaaaacggatatgaataaagtccgccgcaacatcggtatggtgtttcagcattttcatctgtatccgcacaaaaccgtgctgcaaaacatcatgctcgcaccgatcaaagtgctcaaacaatcaaaagaagaagcaaaagaaacggccttatattatttgaaaaaagtcggtataccggacaaagcggacgcctatccttcacagctttcaggcggccagcagcagcgtgtggccattgccagagggcttgcgatgaagcctgaggtgatgctgtttgatgaaccgacatccgcgcttgatccggaaatgatcggggaagtgctggatgtcatgaaaacactcgcaaaagaaggcatgaccatggtagtcgtcacccatgaaatgggattcgccaaagaagtggcagaccgcatcgtatttatcgacgggggatctatcttggaagaagctgcaccggctgagttttacgcaagccctcgtgaagagagggcgcgtttattcttaagccgtattttaaatcactgaaaagaaacgggggaacgattatgtcacgcgtaacaaaatggttatctgtcggtttgatatctctgctggccgtctttatgctggccgcctgcggagggaaagaaacggccggcgattcaaagggtacgggaaaagacacgttagcctcaattaaagacagagacaagattatcttcggcgtcaaaaccgatacaagattattcggactgaaaaatccgagctccggcgatattgaaggctttgatattgatattgccaaacagatcgcaaaagatattctgggggatgagaaaaaagcggagtttaaggaagtgacgtcgaaaacgagaattccgatgctgcaaaacggagatatcgatgccatcacggccacaatgacgataacggatgagcggaaaaaagaagttgatttctcagacgtttattttgaagccgggcaatccctgctcgtcaaaaaaggaagcagcatcaaaagcaccgaagacctcaaaaaaggttcaaaagtgttggcggtaaaaggctccacttcctcacaaaacatcagagaaaaagcgcctgacgcctccgttctggaatttgaaaattacgccgaagcgtttaccgcgctcaaggcgggacagggagatgcgctcacaactgataatgcgattttatacggcatggcggatgaaaataaacaatatcagctgacaggcggcacattcaccgatgagccttacggaatcgccgtcaaaaaaggccaatccggactcgtcaaggaaatcaacgcttctttgaaaaaaatgaaagctgacggcaggtatggaaaaatctataaaaaatggatcaaagaagaaccggcaaaatagaacggaccgcggggtgagcaggcatgctcatccccgttttataaggagtgacatggcatgaacttttcaattttaatggaaaacttcgatatgtacatggacggtttcctgcacacattgcttgcgagcttcatcgcgctggcaggcagcttcgcgctgggcgttctgatcgcagtcatgagaatcacggctttcaaacccatccaatggatcgggactgcgtatgtggaatttatccggaacattccgcttctcctcatcaccttcgtattttatttcggacttccgaacgccggactgagactggacggctttcaggcggggacgattgcgctgacgatatatacgtccgcttttatcgcagaagccatcagagccggaattcagactgtctccaagggccaaatggaagcggccagatcgtcaggcttcacctacagtcaggcgatgagatacgtgattctccctcaggccgttaaaatcgtgattcccccgctcggaaaccaatttctcaaccttgtcaaaaactcatcaatactcggagtggtggcgggactggatttgatgtatcaggcggatctcgtttcctcaagcactctcgtcgtgtttgatgtctatatctttgtcgcgcttttttatttgatgttaacaataccgctcagcatcggagttcactatttggaaagacgcctcgggaaaagttattaaaaaaggagagtgaaaaacatggattttagcggcgcctatacatcggatcatctgctgtttttatggaacggctttttgatcacactttatgttgcgctcatttccattattctcagttttattttcgggcttgccgccggcactttgcgctatgcgaaaatccccgccgtctcaggcgttatagccgcaattgtcgaaaccatccgtaatctgccgctgttattaatcattttctttacgttttttgccctcccggaaatcggcatcaaactggaaattaccgcggccgccatcacggcgcttacgatttttgaatcggccatgctgtcagaaatcatcagaagcggtttgcaatccgttgaaaaaggacagattgaagcggcgcggtcttcagggctgacatatacgcagactctttttctcgtcgtgatgccgcaggcgctcaggcgtatggtccctccgattgtgagccagttcatttctttattaaaggatacgtcacttgcggtcgtaatcgctctgcccgaactgattcataacgcgcagattttaaacggacaaagcgctgacggagggtatttttttccgatctttctgctggcggccctgatgtatttcgcggtcaattacagcctgtctcttgcagccagacggctggaagcgagacaaacgtaaaaaggatacttccgaagaagtatcctttttcacttaaaacattttcatgactcgtcttctcatccgtttcataccttttttattcagcatatcggactgagaagccatacgatacataacggctcctgctcctaaagccaatagagaggtcattgttctgcccatcgcgcgtatctcctttcaacattaaaaattgatactgcgttcgtcttcagaaaacaaatcatcaagactgcttaacgtgccgtcttcctctacttgatgtgtcgcaattttgcctttggccaccgtcagctcaataaagcagccccagcaatagtattggtttacgccgattttgccgatatctttacttttgcagttcggacatacaagcacagactacacctcttatccgttcaggacgataccgtctttccccgcttcaataagcgtatcggcggcccggcgcacttggcgtctgcctgccagatctgaaaagaaaccgtccgtgagttcatatgctacgattatgcccttgtccaaacaaaagtatacatcttccagcaaaccgaacatttcaccatcaggcgatttcaccggctgcatcttaatctgttcaaaggtgaaacagctcttcggcaaaggctgcaaatgagcttcggcggcagctacggcttcttgatccatctcttttatatcactggctgctaaaaaaagatggcggttgtgaaacaggcgtttctgctccagcacaaaaccgagaaaccggccgtcaagagagaaacacacatccgaaatcatcccgaggctgcgccggttgtgttcgtcataaactgttcgtccttcagctgcatggcatgttctcaaagtgtgatcaaccaccttttgttgaacacgtataggttttgccgagaagccgggcgccatactttgaaatgacttccacaataaaacccggcgtatgtgccgggttttatttacgctttttcttccataaagtcaaacggcgtaatgccttccattccgatgttggcatcatatacactgaacggcagttctttttgcagagcggccagttctgcatccatctcttcagtctgctctgtgagcctgtttttaagcgacgtctgtctgacggtggcatcattgtttttgacgccccattcaagcgcttcttcttctccgcaaaggatcagaaatttcttggcccttgtaatggcggtataaaggagatttctcctaagcattcgatagtagcctttgacaacaggcaggacgacaatcggaaattcacttccctgagacttgtggatggaacagcagtaagcatgggtaaactggctgaaatcctttttcgtaaaggtgatttcattaccgtcaaacgagacgacgaccatgtcttctttttccgtattttctttggcataaaaaatggacacgatttcgccgatatcaccgttaaacacattgttttccggctggttgacaagctgcaatattttatcgcccgtcctgtagacgacatctccgaatttcagctcccgccttttttctttcggcggattcatgatgtcttgaagaagtatattcagctcgttaattcccgcttttcccctgtacatcggcgcaagcacttgaatatctctggaggtatatcccttctttaacgcgtttgaaacgacttgatcgacgacttctttaatctgtgcagaattacagcggataaatgagcggtcttttgtcggcgcggtcagtccttttggaagcaatccttttttcatatcatgagcaagttcgacgatggatgacccttccgcctgacggtaaatatctgtcaggcgcactgtcggcagcacctcagaagccaaaaggtctctcagcacctgccccggccccacggaaggaagctgatcttcatcaccgacgacgatgagctgaatgtgcttagggagcgccttaaacaaatggctggcgagccaaatatcgagcatactcgcttcgtctataatgatcagtttcccttcaatcggctgatcttcattgtaggtaaagccttcagcgccattccagccgagcagcctgtgaatcgtaacagcaggcagacccgtagattcgctcatccgttttgcggctcttccggtcggcgcggcaagcagcaccggaaacgcctcgtcttttttataatcaccgggatcaagcgatacgccgtggagttcactgtataattccacgattcctttgataacggtcgtttttcccgtacccggtcctccggtcagtaaaagcatcggcgacgacagcgctttttgaatggcatccttttggctcggagcgtattgaactttcatccgttcttccagttcgccgagcgcaagcagaaattccgattcaggaaattgatcggcatactccgtctgagccgcaatgtcgagcacgcgttttgcgacattttgttccgcgtaaaacaaagacggaaaatagcagcggtctccttctatgacgatgtccttactctctccgagggcgatgatgccgtcagccgcatccatttccgtgacgcggcctccgtcagctgactgattcagtagcgtttgcgtattgataatcagctgctttgtgtctatgtaagtatgaccttctgaaaggcaggtcgattcaatcgtatataagatcgccgctttgatccgctcgggatggttccctgacagacccatttttccgcccagctcgtcggcttttacaaagccgatgccttccacgtcctttacaagctgataaggattctcctgaattttctcaagggtttccgtttcgtaagcttgataaattttcatggaaagctgaggtccgaaaccgtattggttaagagaaatcataatctgctccagcccctgatgccgctgcagctctccggcaagcttatccgctttctttttggacattttcggcacatcgtaaagcaccgacgcatcagccagaattttattcagcgcgccgtctccaagctttttgacgatttcttccgccgttttttttccgattccttcaaacagatcacttgataaatagtgaatgatcccttctttggtggtcggaatttcttttttaaagtgttcagcctggaattgcaggccgaacttgggatgtgtggcggtttttccgtaaaatgtgtaagtctcatcttcttgcagcagagggaagtagcccgttacggatacgaccttgtcttcgatcgcctcagacgtttctgcaaccttgaccttcagcactgtatacaggttggtgtcattgtggtaaatgaccgtatgaataacgccttttacatacggttgttcctcgattttcagctgatccacgagccttccctccttccgttatgactgggtgataagctgttttgcatgaagcgcaagcatatgatcaggctgtatgccgattgcgccttcaagcatctcaagcgccttttcacgattttctttgtaggcgtaagcgactccggcattataaaatgcgtccgcgtggcttgggtcctgctcgatcaccgtctcaaactgcgccaatgcttcatccagcatgtcttcgtttgcgagacacattccgaactggaaccgcgcttccgtatcgttttcgttcaattcaacggcccgctgcaaatacggcagcgcaagcttcggctgctctaatttaacgagaacggttcccagcatataaaacaagtctccgttttccataccggagcgaagcgctttttcaaacatatccttcgcttcagaaaacgattccttcatcacatatacgtttcccgctccgtaataagcggctgccgctgaattgtccaattcaagcgctctgttgtaaaaagcaagcgcgcgttcgagttcgtttacagaagaaagcaggttcgcaaagttgatatacggcaccggatcttggccgttttcctcaatcgctttcgtaaaagcctctgccgctttttcaaaatcgccctcctgcatggcgtcgattccgattttattataatccatttttaacttcctttcgctaaaaaacctcaacatgcgagttgaggttttttacatgtgttatacgtaccacaattttgttccgtctttataaacgtcatcaatcgttccgccgccgaggcactcttctccgtcataaaaaacgacggcttgtcccggcgttacagcacggacctgcttgtcaaaaatgatttccgcttcgtcagcacccgtcattttcaccgtaactttgtgatcttcctgacggtagcggaatttcgccgtgcatgtcatttcgccgccgtccatcaaacccggacgcgtccagctgatatttgtcgccgtaattttatcagaatacagaagcgggttatggaatccctgatcaacatacagaatgtttttttcaagatctttaccgacggcgaaccacggctcgccgcttccgccgattccaagaccgtggcgctgtccgatcgtataatacatcagtccgtcatgacggccttttacttccccgtccattgtcatcatatcgcccggctgagcagggagatattggctgagaaacgttttgaagttgcgttcgccgataaagcagattcccgtgctgtcttttttcgccgctgtcgcaagttctgcttctttggcaatttcccgcacgcggcttttttgcagatcaccgatcgggaacatgactttactgagctgttcctgattgagctgattcagaaaataagtctgatccttgttttcatccaggccgcgaagcatgcgcactgtatctccgcttcggtccacgcgggcgtaatggcctgtcgcgaggtaatccgcgccgagtgataaagcatgatccaagaaagccttaaacttaatttctttattgcacatgacatccggatttggagttcttccggctttatattcatcaaggaaatattgaaataccttttcccagtattgcttttcaaaattgacggcataatacgggattccgatctggttgcagacccggatgacgtcttcataatcttccgtcgccgtgcaaaatccgttttcgtccgtatcatcccagtttttcataaagattccgattacatcgtagccctgctccttcagcagaagggccgccacggaagagtccacgccgccggacatgccgactacgactcttgtatcctccggccgtttttccatttgcattcactccattaaaaacgtaagtccgccgttttaagcaagccgtttgacgacggcggcaagcttttcggcggctgtttcgatttgttccgccgtattgccgaggccgaagctgaggcggattgacgaggtcagcctgccgctctcacttccgaacatggccgtaagaacatgagacggaagaacggaccccgccgtacacgcagatccgcttgagacggcaatgccttccatatcaagattgaccagcagcgattccaccggcacaccgggaaagtaaaggtttaaaatatgcggcaggcagttctcggcatctccgttcacctccgctgtgacgccggctttttccagcgtgctcatgatgatgtttttaaactccttaaacatcgctgttttctcttcccgctcacggtttgaaagaacgaccgcttcctttaagccggcaatgcccggtacattttccgtacccgcgcgccgctttcgttcctgctcgcccccgagaagaatcggtgacagcttcacctcttgatttacatataaaaagcctgtcccttttggcccgttaagcttgtgaccggaaacagacagcatgtcaattctgctttttttcacatcgatcggtatataaccgaatgcctggacggcatctgtgtgaaaataggcctgatgcccgcttaacagctctccgatttcgtcaatcggctgaatggttccgacttcgttattgccatacatgacggtaacaaggattgtatcatcacggagcgcttctttcacctgatttgcactgatccgtcctgaagggcccgggatgaggtatgtcacctcaaaaccgtcttcttccagcttttcgcaggcgtgtaatacggcatgatgctcaatagcggtcgtgataatgtgtttcccttcattcttccgggcggcagccgtgccgagaatcgctaaattatcagcctccgtgccgccgcttgtgaaaatgatttcctgttctttcgcactgatttcacgcgcgatgtccgctctcgcttcgtcgacccatttccgggactctcttccgaatgaatgaatgcttgacggattgccgaagctgccgaagaaatgaggcttcattttttcgagcacacgctcatccatcggggaagtcgcggcgtgatctaaataaatccgttccattgtctttacacctctggtttaaatatagaacatataagcttcctgctcgccgtccgtgtagctcgcaaggtcttctaacgtcgtactgtccagcacgtcttttacggcgtcgcggatgcggatccataactcccgcttggcaggctcttcatcctcaagcacttctaccgggctgatcggcccttccagcactctgataatatctccggccgttatctcttcaggctggccgccgagcacataaccgccgtaagcgcctctgatgctttttacgagtcccgcgtttctgagcggtgatacaagctgttccaagtaatgctcagagaggctgtttgtttgggcgatgcttttgagcgacgtcggaccttctccgtgctttttcgccaattcaatcataatggtgagcccgtatcttccctttgtcgatattttcaatatgaacaccccagtcaattctaattgttaatttatacaagtaaatggatatgaataatcagtttagtatcttatagaccaactgttattataacataacttatcctaattttcattgaaacacggggcccgccgcaattcgcttttctaatcggccgttttccgttaccctgtatatgtaaggagagatgttcatgaaaccattggcgtatcggatgcggcctgccaatatcgaagacattatcggccaggaacatttggtcaaagaagataaaatcatcggcagaatggtgcgcgcaaagcacctatcatccatgatcctgtacggaccgccaggcatcggaaaaacgtccatcgccacagcgatcgcaggatcgacaagcatcgcattcagaaaattgaatgccgtcattcataataaaaaagacatggaaattgtcgtacaggaagcgaaaatgtcaggtcaggtcatcttaatacttgatgaagtgcacaggcttgataaggggaagcaggattttctcctgccctatttagaaaacggcatgattattttaatcggcgcgacgaccgccaatccttatcatgccattaacccggccatcagaagccgtacccagatattcgaactcgaaccgttaacaccggatctgatcaagcaggcattgagaagagcgctcacagatgaacaccggggactcggttcctacagcgtttcggtggacgacgaagcgatggatcatttcgcgcaagggtgtggaggagacgtccgttccgctttgaacgcactggagcttgccgtgctttccacaaaggaatcaagtgacggcacgatccgcattacgcgggaaacagcggaagaatgtctgcagaaaaaaagctatacccatgataaagacggagatgcgcattatgacgtcttatccgcattccaaaaatcaatccgcggctcagacgcaaacgccgcacttcattatttagcccgactgatcgaagccggcgatcttgaaagcatttcaagaagacttctcgtaatcgcctatgaagatatcggccttgcaagcccgcaggcaggcccccgggtgctgagcgcgattcagaccgcagagcggatcggctttcccgaagcgagaattccgctggcgaatgcggtaatcgaattatgcctttcgccaaaatcaaactccgccatctcagccgttgatgaagcgctcaaagatatcagatcgggtaaaatcggcgatgtgccgaaacatttaaaagacgcccactataaaggagcccaagagctcggacgcggaatcggctatcaatatcctcacgatttcgaaaacggatgggtcgaacagcaatatttgcctgaaccgttaaaaaacaaacaatactataaaccgaaacaaacggggaaatttgaagccgccataaagcaagtgtatgaaaaactgctgaaacagaaaaaataatcggacaaggacacccaatgtgttcttgtcttttttttataccggccggccattcgtgtgaacggcggctttattcaaataaaaaacagcctttcctgaagaaggctgtttttctttttatttatctttgacccgtttaatgtcaatatcctttaagagctccataatgacatgtccgcccataatcagaccggccactgacggaacccaggcgttggaagacggcggcatttgcgctttgcggattttcgcttcgtcattcccgacttcttttctgacatcttcacggatgacgatcgggctttcatcagaaaaaatgacctgaacgccttttttaatgccctctttgcgaagcctagtacggacgactttggcaatcggatcagtatgggtttttgaaatatcagcaatctgaaagcgtgtcgggtctgttttattcgccgctcccatgcttgaaatcagcggcacattccgtttcagacattctttcatcagatgaattttataatgtatcgtatccgacgcgtcaatgacgtaatcgagcggatactcaaagaactgctcatacgtctcttccgtataaaacattttcaaggcgacgacgtcacaatccggatttatatctgcgatccgcgctttcatcaagtccgttttcggctgccccaccgttgacaagagagcatgcagctggcggtttacgtttgtaatgtcaacatcatctttatcgacaagcacgatccgtcccactccggacctcgccaatgcttcggctgcgaatgaaccgactccgccgacgccgagaacggccaccgtgctgttttttaacgtgtccagcccttcttttccaatcgctagctcatttctggaaaactgatgtaacaagaacctcactccacattctggttttataaactcggcttgtcaaaaagccgctggttttaacgcacaaaaaataaagtcccaattgtgccgttgcagctttccttcgttttgaacccgctctcagcaggtgggtgcccttttttaaactttgtaagtcccctttaccgaatgaaaagaggcatgtacgccatttaaaaatacgggctcccaaatcaaaaaaatgttcggtcaaaactaggtgtacaactaacacatcaggactttatttaacttgtcaaaatcatatcacagcagtttttgattttcaagaaacaaactgctgatctttactgtttcacttttcttttgacagaaaggtgaagttcttcaagctgggcgtcgctcacttcgccgggcgcttccgtaagaagacagcttgcgcttgccgttttcgggaaagcgatcgtatctcttaagtttgtgcggcccgcaagaagcataaccaaacggtctaagccgagcgcaattccgccgtgcggaggagcgccgtattcaaaagcttcgagaaggtatccaaactcctcctccgcttcttcttttgtaaagccgagaagcccgaacattttttcctgaacgtctttctcaaaaatacggattgagcctccgccgagttcatagccgtttaagacaaggtcgtaagcctgcgctttcatatcctcaggcgccgtttcaatcaggtcaagatcttcacggacaggcattgtaaacggatggtgagccgcatagaaacggccttcttcctcgtcatgctccagtaacggccagtccacaacccacaggaagttgaagaggctttcgtcaatcaggccgcgttctttaccgagctttaagcgaagcgcgccgagggattgggccacaacctcaaacttatcagcgccgaacaggagcaggtcgccttcagaagcatcaagcgcttctgccagttttgcctgcttctcattatcaaagaatttcgcgatcggaccttttacgccgtcagcttcaactttgacccaagcgagacctttcgcgccgtaatttccggcaaaaacgccgagcgcatcaatatcttttctggagtagtcgccggcagcgcctttgacattgatcgcttttacaacaccgccgttggcaacggctgatgagaacactttaaactcagtatctttcacaatgtctgatacgtccgtcagcagcatgccgaagcgtgtgtcaggcttgtcggagccgtagctgttcatcgcttcttcatatgtcattcgcggaagcggcagcgatacttcgacgccttttgtttcgagcatgactttcgccatcatcttttcggccagagccatgatgtcttcttgactcataaaggacatttcgatatcgatctgcgtaaattccggctggcggtcggcacgcaggtcttcatcgcggaaacagcgggccacttgataataccgttcaaagcccgacaccatcagaagctgtttaaaaatctgcggcgattgcggaagagcgtaaaattccccttcatgcacccggctcggcactaagtaatcacgggcgccttccggagagcttttcgttaaaatcggtgtttcaatatcaagaaatccgttttcatccaagaaatggcggatggattttgtgacttgatggcgcatttgcaatgtttgaaacatcgccgggcggcgcaaatccaaatagcggtgttttaaccggacgtcttcagaaacgtcagccgcttggtcactgatcggaaacggcggcgttttcgccgtgctgagcaccgtcactgcttcagctttgatttcaattttaccggttttcaggttgggattcaccgtgccttcttcacgggcagaaaccgtgccttcaatatcaagcacatattcatttctgattgcttctgccgcggcaagggcttctttcgagacgtcaggattgaacacgacttgcacaatacccgaacggtcgcgcaaatcaataaaaatcaagccgccgagatcgcgccgtttctgcacccatcctttcagtttgacggtttcgccaatcgctttttcagttatttcgccacaataataggttcttccaaacatagcgttcctctccttcactgcttttgatctgcctttaacacttgtatcagctcgtctaacaccacttcacgctgctctcctgtttccgcatcttttacattgattttattttgggcgagttcatcttcccctaaaatcgcaataaagcgtgcgccgagacggtcagccgttttgaattggcccttcatttttttgttttcataatcgatttcacttgagatgccagcttctctcagtttgtacacgagagaaacggaataatccttcgctttttctccgagcgtcacgatgtagcagtcaatcccctgattgacaggaagctctgttttctcagcgtcaatggctgccagcagacgttcgatgctcatcgcaaatccgatacccggcgcttccggtccgccgatctgttcgacaagcccgtcatagcggccgcctccggcaagggttgtaatcgctccgaagccttccgcattgctcatgatttcaaaagcggtatggttgtagtaatcaagccctctcacaaggttcggatcaatttcaaacggaatgccgagcgccgtgatgtactgctgcaccttttggaaatatgcggctgattcttcatttaagtaatcaagaattgacggagccgttttcatcagctcatgctctctgtcttttttgcaatcaagaattctgagcgggtttgtgtgcagccgcgactggcagtctgagcaaaattctccgatacgcggttcaaaatgtttgacgagcgcttcccggtaggctttgcggctgtcctggtcgcccaggctgttcagaacaagcttgacatttttcaaaccggctttacggtaaatactcattgcaagcgcgatgacttctgcatccacggccggatctttggagccgatcgcttcaattccgaattgatagaattgacggaagcgtcccgtctgcggacgttcgtaacggaacatcggtccgacataatacagcttcgtcggctgcaccggatttgcaaataatttattttcattgaacgcgcggactgcagcggccgttccttccggccgaagcgtcaggcttctccctttacggtcttcaaaagtgtacatttctttctgtacgatatctgtagactcaccgacgcctcttgcgaataattccgtatgttcgaagatcggcgtgcggatttctttatattgataagtgcggcacgtctctctcataatttgttcgacgaactgccatctgtctgattcacccggcagtatgtcctgtgtgcctcttggaatgtgatatgccatgttacaggcctccttaatgtctttcttcattaaaacatgaaataaaaaaactcccgcccctactatacatgtatagtagggacgagagttatacccgtggtgccaccctagttggaatgccgaagcatccccgctctgaccgttaacgcaggttcacgtccgctgcctaatgactgatgcccttttccggcaaagcgttcagcagggaacctccggagtgttgtttcgagaaagatgcagtgcggatccgctttcagcctgggacggttcctctcttctccatgcattctgacctactcttctccattatcggttcaaaatcgttatcatgacttatgtacatcaatttctattataataatgggattgcacgcccctgtcaagttttattccgtctgtttttccttgcgaccgcttctttcgataagagaccgaactccgttgccgtctcttcaagaaaaccgtccttctctctatcgctctgatcactgaagtgaagatttccttccgcatcgtgcagcgcgcgtcccatttttggttgaaatttcatgatttgcacaccttttcgctgtatttatgactagtataaacaaactattttatttttatttaacattcagcaaggaaaatgcgatattatacaagaatgtattttagttagttcagaaaggaggacagccatgagtaagagaactcttgttcttattttatgcggcgtcatcatcacagcgcttcttccgtcattccacaccgcagtcgccgcagagggagaagcggtcatcgcgacagacaagatcaatgtcagaggcggtcccggcctgagctacgaaattaaggctgaagtaaaaaaaggggaaagataccccatcctcaaggaagagggagactgggtgcagcttcagctgagccccggtaaaaccggatgggtcgtttcctggctgatatcaaaaacagccggaggagcagacaatgcatccgcaaaaagcggaacggtcacttccactgaccctgacctccgcatcagaaaaggcccggggacatcatatgaagtcatcggcaagtttccgcaaggcgcacatgcatccatgctggacaagaacagcggatgggtgaacatttcttatcaaggcacaaccggatgggtttcttccgaatacgtcaccgcggacagcggcggatcggatacgaaagcaaattcgtcccaaagcggttcaaagaacgggaccgtcggcgtttcttcattgaatgtcagaagtgcagcgtcacatgattcagccattatgactaaattatcacgcggaacaaaggtttccatcttaagcgaagatcacggctggctgaaaattgaagcaaacgggcaaagaggctgggcagcaagccactacatcataaaggattctgactcatcggacagcgcggccggttcgggagacagctcagacacctcgaaaaaagcgtatatcgtttacggcggcaccaacttaaggagctcagcctcgacttccgcttctatcgtaaaaagagcggataaaggcgcagcctatccgattgtcggctcaagcggcaaatggtatgaagtccggctagaaaacggacaaacagcatatgtggcaaactgggtcgtgcaaacgtctaaaagcggtgaagaaacaggagaagcaccttctcccaacacgtcaggcggcagcggctcacttaaaaataaaacgatcgtcgttgatcccggacacggaggtaaagacagcggaacgatcggctactccggaaagtttgaaaaaaacgtaacgattaaaaccgctaagctgctggccgggaaattgagagcggccggtgcaaacgtgtatatcacaaggcaggatgatacatttatcagcctgcaggccagggtttcaacctcccattacaggaatgcggatgcctttatcagcatccactatgacagctatgccgatacgtcaacaagaggaagcaccgcttattattacagtccgtctaaggaccggcagcttgcctcagacgtccattctgaagtagtgaagcgttcgcctatccccgatcgcggcgtactgtttggagattattacgtcctgagagaaaataaacggcctgccatgctgtatgagctcggctatctcagtcaaccgcaagaagaaacaatcatacatagcggctcttaccaggaaaaagtgacagacggaattgaaagcggattggaacattattttcaatcataaaaaaaaagctgccaaacggcagctttttttattgtttagaatccataatcaatgtaacgggcccggaatttgtcagctgaacatccatcatggccccgaatattccggtttccactttgactcctttttcccgaagaagttcgttccacttttcataaaggagcagagcctgatccggtttcgccgcattcataaaattcgggcgtctccctttcttcgtttcgccgtaaagcgtaaactgggaaactgataaaatctctccgcccgtatccaaaagcgataaattcatcttgccgctctcgtcatcaaaaatccggagattcacgattttatcggccaagtaggcggcatcttcctctgtatcttcatgagtgacgccgacaagcgccataatgccgggtccgatccggccggcgacagcgccgtcaactgtcacacttgcatctgttacacgctgaacaactaatttcatagcaagctccttttagttcattacccggcggactgaatatatgtctctgatctgcttaatccgctcgaccactttgtgcagatgattgatgttttgaataaaaatcgccatatgaatcgtagcgactttattgcggtcggatttgcccgagacagacgagatgttggttttcgtttcgtttacggcctgaagcacttcatttaacagcccgagacggtcataccccagaatctcaatctcaacgttatattctttgcgtctttgaacttgtgattcatgctcccattcaacagggatcaatcgttcctgcgcttcattcgtttttacgttcggacagtcatcacggtgaacggatacaccgcgcccttttgtaataaaaccgacaatatgatcgcctggcaccgggttgcagcatttcgacaaacggacgagaaggttgtcgatgcctttcacgcgcacacccgcttcccgttttctcccttgcggatactgtttcggctcggaagtgacttcctgaacgattttttcctgctcttcctgatcacgcagcttccgttctttttcggtgagcctgtttgccacctgcaaagcggtaatcccgttatacccgaccgccgcgtacatatcctcttcatttgagaaattgaacttgtcggcaaccttttgaaggttttcgagcgttaaaacttccttcacttcaaaatcaagatttttaatttctttttcgaccagctcacggcctttttcgacattttcttcacggcgctgtttcttgaagaattggcggattttgtgtttcgcctgtgacgtctgtgcgagtttgatccagtcttgactcggaccgtatgaatgcttggacgtcaggatttcgacaatgtcgcccgtccggagcttatggtcaagcgtcaccattttcccgttcactttcgctccgatggttttgttgccgatctcggagtgaatcctgtaggaaaaatcaatcggtacagagcctgacggcagttcaatgacatcgccttttggcgtaaatacgtataccatgtcagaaaataaatcgattttcagcgattccataaattcttccgcatcggtagattcgttttggaattccagaatttcgcggaaccaggacagttttttctcaaatgtcgcttcttcgtttgcagccttgccttctttatatgcccagtgtgcagccaccccgtattcagcgatctcatgcatctcaaacgttctgatctgcacttccagcggatcgcctttaggcccgattactgtcgtatgcagggactgatacatattcggcttaggcatcgcaatataatctttgaatctgcccggcatcggcttccagcacgtatgaataatgccgagtacggcgtagcagtctttaatgcttccgacaagaatacggacggcgagcagatcatatatttcattaaactgtttattttgcagcgccatcttgcggtaaatgctgtagatgtgcttcggacggcctgaaaagtccgctttgatattcacttcttcgacgcgttttttcacttcattgacaacctcatcgacataaagttcgcgttccgcgcgctttttcttcatgaggttaacgattctgtaatattgctgaggattcaaataacggagagcggtgtcttcaagctcccatttgattttagaaatcccgagccgatgggccagcggagcgaaaatttccagcgtctcatttgaaattctccgctgcttttcctgcggaagatgctttaacgtccgcatattatgaaggcgatccgccagcttgatcaatatgactctgatatcctgagccatagcgacaaacatttttcgatggttttccgcctgctgctcctcttgagatttatacttaattttaccgagcttcgttacaccgtcgacaagcatcgccacttcttcagaaaatgcttccttcaggtcatcgagggtgacatccgtgtcctcgaccacgtcatgcagaaatccgcccgcaatcgtggaagggtccatttccagatcgacgaggattcccgccacctgaatcggatgaatgatgtacggctcacctgatttgcgatactgttcgcgatgcgcgtcttgcgcatacagataagctttctcaacaaacgcaatctgctcctccggcagataagtgcgcgctttatctattacttgctcggcagtcaatacttgttcgttcgccatggaatcaccttttttaaatgtaaactgtattagtttattatcaagaaaaaaacgagagatgtaaagggcagaagttcaaaacacctaaagaatctgtcaggatgatgaaataataggaaaaaagcaccctgacacgagtgcttttttccatatgcggtttaatatttcattagtgttaaaatatcgtaatcgtcaagctttgctctgccgtcaaggtaagaaagctcaattaaaaacgcaataccggctacgacgccgccaagctcttccacaagcttaatcgttgcttcgatcgttccgcctgttgccaataagtcatcagtaatcagaacgcgctgtcccggcaggatcgcatctttatgaatggtcagtacgtctttgccgtactccaaaccgtaatcgactttaatgacctcacgcggaagttttccttctttccgaaccggcgcaaagccgactccgagcgcatatgcgaccggacagccgataatgaagccgcgcgcttcgggcccgacaactaaatcaatttctttttcttttgcatattcaacaatttggtcagtcgcgtaacggtatacgtcgcccttgtccatcaatgtcgtaatatctttaaattgcacgccttctttcgggtaatcgggcacaattgttacgtattttttaagatccatctgttctatgtcctcctcgtactttcataagcctctgaaccttggttcatcagcttattcagccattccttcagctcatgggctgcggaataattgagcttctggtctaattccatcagctgctgttttacctgataggtttgcgaatctgcgaggtcgcgttttttcgcgccgctcacgacagacagcacaccatcttctattttaacaaaaccgagatcaaaaaacacctttgtcatgaaattgattgtgtcaattgaccatcctctgtgtctcgcaagctctgaaccatgcttgcctaagttaaaagtgccccttttcaagagaaatgcgtaaaaccacttgaagtcattccgcgatggaaatgaggacaggaaatgttcttcatgattaataaaaacaaaataaatccgttccggcttcttcccgtcaagcaaacgctggaggcggtccgctgatggcggcacatccagaaaaacggcatactttccgtcaagcggaagagcttctgcttcggattccgacgtgatctcagccagctcacccgaaagctcggcacggagctttcgggcggttttttcgttaaagctgatgagcacccgtttttccttaggcagcgcagtgaccgtatcttcccacatccgcttgcccctgatatcaaaaagctgccattccggcaccgcagcatctttaatcatcagctggggtttctttctgttgttccattcattaatagacatctcgccgacaatggaaatcgttgatccgggaacaatcccggcttcaagctctcctttgttaaagccgacgcagtcgagagcggcggaatcatttttcaccgtcattttcacgtgatttttatttgctccgatcaggcgcacctcatcaagcacggcgttttccaccatcacatgaggtttagggtttagcatgccgaacggcgacagcatattcaattctgtaatgctttcaacggtgatgtcttcgacgccgcagacaagatcaacctcctgaacggggataaaatcctcttcggtaagggtttcttcagccatttgattcagccgatcccttaaatccgccacatcttcagccttcaaagtcattcctgcggccatcggatgtccgccgaaatgaggaagaatgtctctgcactgtgacaggctcgtaaaaaggttaaagcctctgatgcttcgcgccgaccctttggcgattccctgctcctcatccatccccagcacaacagcgggccggtaaaagcgttcagccagcttcgatgcgacaataccgacaactcccggattccagccggcttttgccacgacaatggcagaagggtttccgccttgctgctgaaccatttcaacagcctcttcggtcatggttttcaccattttctgccgctctttattcagccggtcaatatccgaagccagctcctccgcttcaaactggtcatcggtcatcaacaggtgcaccgcgggatcagcctgttctattcttccgacggcattcagcctcggtgcgacctgaaacccgatcgtttcctcatcggcttgtccgatatctccgccggaaagcttaatcagagctttgagacccggccgatttgtcgtccgaagcctttcgattccaagcgacgctattaatctgttttcatcatgcagcggcaccagatcagcaaccgtaccgatcgccgccaagtccagcatagcttccggcaaagaacccgtaagcgcgtgggcaagcttaaacgccacaccgacgccggccaattctttaaacggatagctgcagcccggctgcttcgggtggataatcgcaaatacgtcaggaagctcgggtcccggctcatggtggtcggtaataatgacgtctaaaccgagctcttttgcgacttcggcttcatgaacggcggcgatacccgtatccactgtaatgatgagcgaaaatccccgctcttttatggagcggaaagcttgttcattcgggccgtagccttctgtgaaacggtcgggaatataaaagtcaacgttcgctgacagctgtctgagcgccgtcagcatcactgacgtgcttgtaacgccgtctgcatcgtaatctccgtaaatcataatcggttccccgcgggaaaccgccagctttatccgatcaactgcttcccgcattccctttaattcatacgggtcataaaagtctgcatcctttgtatgtaaaaacagccttgcactttcggcagtatcaaaacctctttttacaagcagcgatgccacaagaggtgttatgtccaattgttctgtgagtgatttgaccttttccttatccggctgctggatttcccagcgcatttttgacgctaacataaattcacccctcaaccaccctattatactagagcggactgaggggtttcaaatgttattctgatccttttttctcttccagcatttcttccggcggagcggctggttttctgacgtccggatcagccggcaattcagcagcggatctgttttctttccgcagcattttaatttcacgcttcagcttcatcacttgaaatataccggctgaaaacacgatcagcgcccccattaacacagagcctaaaatgactaaaatcagcggccattcagcggttccgaacagataatcaacctcaaccgcccgcacgttaatgacagcaaaaatggcgacaatcagagtaaataataaagcgaatataatagtccattgtttattcatgcgtcagcccccaattattaattcttatcttttccctcattttcctgcgggtaaaccccgggctcaggacatccgggccgttaactgctcacgaaccagctttttcaatccgcttctttccccagataagacgagggtgtccccttcttcaatcacggtatcaaaggcgggagtcagctgtttttgccggtttttcttcacgatcgcaattacctgaacgccgtattgttccttgatatccaaatctccgattgtgcggctgacagccggcgcatgagattcggctttaaaccactcaatgacgaggtcgtcaagcgcaacttccacagattccagcgctttcggtttatacgtcatcccccctaaaatagcggagatctgcctcgcctcttcatcgttaaattcaacggatgccaagcactcgtcatgatcatcctcatcgaagtaatagagctctcttctgccgtcatcatgaagaataatactgattttatcgcgatttttcgtaatgacttcgactttctggccgatgcccggaagctccgactcacgaacgttcataagaaccctcctacatgtttttacagtgatgattgattatgtaagcgtatgtcattatagcaaatgcaggttttaagttcaatgcagcttgaaaaaacaggctgtcttctgcaagacagcctgtttcccattactcttcgattgattttttcgatttaaattcttttcctttccatacaagccacatctgtgcggcgatgtaaagagaagaataaacacccgtcaataaacctatcaataaggcgacggagaagtttgtaattgacgatgaccctaaaatgagcagcacgacgacaacaatcactacggttaagaccgtattaatcgagcgtgtaaaggtttgctgcaagctcagattcacgatgtgttccagatcggcaaatgacttcggcttgcgctttttcatctgctcgcgtatccggtcaaatgtaacgatcgtatcatttatcgagtaaccgataatggtgagcacagcggcgataaaggtgacgtcgacctccagccttgtaatgctgaaaaacgcgacgataaagaaagcgtcatacagcagggatacaattgcggcgacagccattctgtactcaaaacgtattgacacgtaaataatgatgccgattgatgcaattgccacggcatataaggcattacgggccagctcttttccgactgtcggcgataccgtgctgacattcggttcagctccgtatttgtccttaaagtacgttttgatttcagcgatcttttctttagatggctctccgacaaaccgggccgcggcgacatggttctctttacctgagagcactacgttttccgggtccatgccgagagagtcaaagtctttttcaacctgctgcgccgtcaaggcatgattgctctgcacgtcaatccgcgcgccgcttgcaaaatcgattcccaggttgagtttaaagatcagtaagatgataattcccgcaatagtcacagcacttgagaaaataaagaagtattttcgtttgctcgtgaaatcccatttttggaacgccgtatgcggttcagtattttcatctgttttctggatgtccataatatgttttttcttgacgccgaaccagccttttttccggtcaagccatctgctttccacaagaagggagagcaggaatcttgaaaggaagacagctgtaataaagcttgtcagaattgacaaaatcagcatcgtcgcaaacccttttacagagcttgtcccgaaaataaagagcacgaccgctgcgatgatcgttgtgatattcgcatcgaaaatcgtcgcaaatgaccgtctgttccctgaacggaaagccgagcggacggattttccgagtttcagctcttcttttatccgttcataggtgatgatattggcgtcaaccgccatccctacacccaaaatgagggccgcgatacccggaagtgtcagcaccgcctgcatccagtcaaacacttgaagcgtaatatacacatatacagaaagcgtgataaccgcaatgagacccggcagtctgtaataaagcagcataaataagaaaacaagtgcaatcccgatgatgccggcctctaccgtatcatgtaaagcctgctgtccgaattgcgcccctactgaagtagagtatttttcggtcagtttcacaggcagcgcgcccgcgtttaaaatattggccaagtcctttgctttttgaacggtgaactggccttcaattgtgacatccttcgtatttaattcctggctcacattcggagcggatacatatttcggatgttttttgccgacttcttttttaaatgaatcgcctttttgataatcaagccagatgacgagctgattattaggcgccattttcttgacttttttcgtcacttctccgaacttgtccgcatccttcagcttcacgctgacaatcggttcgttcgtcgtcggatcgaaagtttgcttcgcgccgttttcaacgagatcagagccgtttaagagctctttatcattcgtgtccctgaacgagagctgcgcttccgttgacagaatttcgcgcgccctgttctgattcgtgacgcccgccagctgtacgcggatgcggttgttcccttcaatctgaatgttcggctcgcttacgccgagaacgttagcccggcggttcagcgcctgcaccgtgctgacaagcacgtcttttgtgattttatcgccttttttgacgggctgcacatcgtacagaacttcaaacccgccgcgtaaatccaatcctaacgtaatatttttggcagccggctttgtaaaataccccagccctgtgccgatcaataatacgatcaggaaaaacgcaatcaagcgtccttttttcattatgtatttcctccttaaacctatgccgtcaaatcattatctcagcagttcatccaaagcttcctgaccttcatcgctttccagccaattagacgacttaaaagcttcgacggttgcatagttcataaaatcgccaattttaactgataaaatatcgccggccaatttatacagcggcagttccgttttctgtttccactttttatgtatgaggtatgaccataaactctcatgttcaacatcatcgtatccgaggattttgaactcttcaagtttactgtacaaaaaaggccgcaaatgatctttatacatttcggcgggatgtttctccactgggcgctcgctcctttttccctttttctcgaagacttgtcatgctcggacgacatcggcgcatatccttattgtatatgattccaggtagtttgagaaggcaggggttgtaaaatggcaaaacagacttttttaaggggcactcttattctcatcacagccgggatgattacaagaatgctcggctttgtcaaccgggtggtcatcgcccggtttatcggtgaagaaggggtcggattgtacatgatggctgccccgacatttttcttggccaccactttgacccaattcggcctccctgttgccatcagcaagcttgtcgctgaagcaagcgcccggggggaccgggaaaaaatgaaacatattttagtgatgtcgcttaccatcaccgggatattaagtctcatctttacgccgctgtttttatgctttgcgccgattatggccgaaacgatgctgactgatcaacgcacggtttacccgcttttggcgattacgcccgtcgtgccgattatcgcaatctccagcgtgctgcgcggttattttcaaggcaggcagaatatgaacccgctggcgttttcccaagtgcttgaacaaattgtgcggatttcacttgtcgcggtctgcacgacggtgtttctgccgtacggaattgaatatgccgcggccggagccatgatttcgtctgtcatcggggagctcgcctctcttatttatttattcatttgtttcaaggccaaaaaaacaatcagaatcagaaaacaatttttcaagtcgattgcaaatggaaaagaaaccttccgccagctgatgagcgtgtcgcttccgacaaccggaagccgcttcatcggaaacttgtcttggttttttgaacctattgtcgtcgcgcagagccttgcgattgcaggagtggccaccgctgctgccaccagccagtacggggagctgaccggttttgccatgacggttttgacgctgcccagctttataacctattctctgtcaacagcgcttgttcctgcgatcagtgaaggaatggagcaaaaaaagctgcaagttgtcgaataccgtctggaacaggcgatgaggctgtgtcttttaagcgggggcatttcagtggttattttattctctttcgctgatgagctgatgtccgtcatgtacggatcaacgaatgcagcggtatttattaaagtgatggcgccgttttttctgctttattattttcaggggccccttcaagcggtgctgcaggcgcttaatttagccggggccgccatgatgaacagttttatcggcgccgctgttaaaacaggccttatttttgtgctggcgaccaggccttcgctcggcattatgggcgcggcattggcgattgtgacgggaatggtcctcgtcaccctgctgcatgcggccactgtaagcaaagtgctcccgatcagcattaaaataaaagaatacgcgctctgctttgccgtcatattcatttgcggctatgtgagccgcattataaagcacgccgttcatttttcagggtcagaggctgttaatctcacaggatggattgcaatgaccgtgatactgtacattgtgcttctgctgatattcaggctgattaaaagggaggagctgatccggattccggtcatcggccggtttgtgatgcggtgagtccggtttaaggctcccctttttcatttttgatatcaataaaaaaagccccgtctgtaaacgtgcagaatgatatttccgaaagatcgcgatatcctctttttgctaaatttttttcgagccagtgtttgtctttcccgattctgtctaaatgctcgttttgaacgactccatcgacaatgagcggggtttccagctgcttatccttattgtttttctttttgacgattgacagttttcctgatgactctaaaacggcgtatgacacgtcagaaattctttcgatgttattttccctcagctgcatcagaaggtcgtcaaaattgtagcgctgtgatctcatcgcccgttcgtcgatttttccctgtttaatgatagtggttggcttgccgtcaagcagctgccgtattttttggcttttgagcgagacaaaagcaaggcttacctgaataatcattaaaatgacaatcggcacaatggtatgcaaaagctgatcctctacattttcaattgccaaaaccgctatttcagcaatcataatggaaacgacaaaatccaaaatgctcagctctccgatttcccgctttcccatcagcctgaaaatcacaagaatgatgatgtaaagcactattgtacgaaacgtaataatgaaaatatctcccatatcgcacctccaacggtcatagcatttgccatccgctctgttttatgtaagaaatgagctgaacatgatgcttttacgtctaatccgaacattcagagaatacatttagaaaaagacaggctccggcttgtcatatgtcaggccgcagggcggggaggagataaaaatggaagaaacaaaacaagtgggaaaaggcgtcttgtacggcttagtagctatctttgcagtgatgctgctgacgagtttggcgatttcactgttactgacggtcacctcaatggaagagtcatctttcagctggctgatcaccgcgctttcttttctatctttatttgcgggcggttttatttccggcggcaaagcgaaagaaaaaggctggatgatcggagcgttaaccgccgtttgtttctcgttaatcatcttgctgtttcaatatttagggttcggaaaaacgtttacatccgggcagcttttgtttcacctcggctttttgggagtcagtatgctgggcgggattttcggagtgaatttgaaaggaagcagatcagcgtaataaaaaaaagagcggattctccgctcttttttagtatgtatgagcttcgctgttactcagcggaagcttctctgattgcgcggcggtcaaaagttaaacgggtgttatcacctgttttaatgacgaccttgctctcatcaattgaatcaacagtgccgtgcaatcctccgattgtcaccactgaatctccttttttcagctcttcctgcatctggcgtacagccttctgctgcttttgctgcggacggatgagcaggaaataaagcactgcaaacattaaaataataggaacgattgtacctaaagtacccatctgtttccctcctttcaaaaatggtttttatttagaagcttttcgcatttggcttattatagccgtaacgctcaaagaactcttctcggaaatcaccaagacgatcctcccggatagcttgtctgacctgctccattaagtgtaacagaaaatgaaggttatggtaagttgttaatcgaattccaaacgtttcattacagcggatcaaatgtctgatgtaagcgcgggagtaatttttgcatgtatggcagctgcactcttcgtcaatcggacggaaatcgcgctcatatttggcatttttcatattcaggcgcccttcactcgtgaacaccgtgccgtttcgggcaatccgggtcggcagcacgcagtcaaacatatcaacgccgcggatggcgccgtcaattaaggcatccggtgaacccacacccattaaatatctcggcttgtccttcggtaaaagcggagttgtaaactcaagcactctgttcatgacgtgcttcggctcgccgacagataatccgcctatggcatagcccggaaaatcaagcgaaaccaagtctttggcactttgtgtccgcaagtcttcgtactctccgccctgtacgattccgaacagcccctgctcatcagagcgtccgtgcgccttcaggcagcgttcggcccagcggctggtccgttccacagagcgcttcatgtaatcatactctgccgggtacggagggcattcatcaaacgccatcatgatatcggaaccgagggcgttttgaatttccatcgctttttccggagataaaaacagcttgtctccgtttaagtgattgcggaaatgaacgccttcttcttctatattacgaaacttacttaatgaaaagacctgaaaaccgccggaatccgttaaaatcgcgcggtcccagttcataaactgatgaagcccgcctgcttcttttacgatgtcatgtcccgggcggagccataaatggtacgtattgcttaaaataatacccgcatccatagatttcagctcgtccggagacatcgtcttcaccgtagcaagcgtgccgaccggcataaatacaggcgtctcaaaggagccgtggggcgtatgaactctgcccagacgcgctcccgtttgtttgcattcctttataaattcataacgtatcggttgttcagccattttgtatgaggcctcctgtcattcaaattagataatcagcatggcgtcgccaaagctgaagaaacgatattcctcttctaccgcatgacggtaggcggaaagcacatgctctctgccggcaagcgcagaaacaagcatgataagcgaggatttcggcagatgaaaattagtgatcatgccgtcaatcgctttaaattcatatcccggataaatgaagatggacgtccagccgcttgaagcggtgaatacgccgtcatgctcgccggcaatggtttcaagggtgcgcgttgatgtcgttccgaccgacacgatgcgtccgcccgcctttctgacctcatttaaagaggcggcggtttcttccgtcatttcataaaattccgcatgcatgttatgctcttccacatcatccgcactgactgggcggaaagtgccgagccccacgtgaagggtgataaattcaatccgcacgcccttttgcttcagctcgtccaggatctcttccgtaaaatgaagtccggccgtcggggcggcggcagaaccgatttcttttgaaaagacggtctgataccgctctttatcatcaagctgctctttaatataaggaggcagcggcatttcaccgagagattcaagcacttcataaaaaatcccgtcgtaccggaattttatttttcggccgccatgatcaagctcctccgtacagaccgctgtcagccggccgtcgccaaatgtcagaatcgtaccttttcttacgcgtttcgccggctttacgagcgtttcccatgtatcgttttcttcctgttttaataaaaggagctccactttcgctcccgtatcttcttttgtgccgaataatctggcgggcagcacacgggtattgttcaaaacgagacaatccccttctttaaaaaagctgacaatctctttaaatgaactgtccgtcagtccgcccgtctgtttgtcaagcaccatcagccgcgatgcgtcacgctctttcagcggcacttgggcaatgaggcgttcaggcagttcaaaatcaaataaatcgactttcatcatttcacctttattctgtctattgttatttcattctgccgaaaaaattgagcagaatggatagtatcacactgatcacaatacaagtgacaacgggaaagaaaaatgtgacatttcccttcttaacgaaaatatctccgggcagccttccgacaaagtgccagactgcgccgacaataagcaaaacagcaccgagaaccatgagaatcttcggaaattcagtcacaggcgggtgcctccaatcgaaaatgctcatacacagccggggtcacgacccgtcctctcggcgtcctttggagaaatccgatctgaagcagatacggttcgtacacatcctctattgtatgcggttcttcaccgattgtcgcggaaatcgtatcaaggccgacgggaccgccgctgaatttttcaatcatgcccatcagcagcttatggtcaatatggtcaaggccgagtgcgtcgacttgaagacgttcgagcgcgtcgtgagcgatttcttccgtgatgcggctgtcacctagcacttgggcaaaatctctcacccttctgagaagccggtttgcaacccgcggcgttccccttgaccgtctggcgatttccaaagccggggcttcttcgatttcaacttcgaatacttcagccgttcttgacacgatatctgtcagttcttcctgcgtatagtattcaaggcgggacagcaccccgaaccggtctctgagcggcgcggtcaataagccgaccctggtcgtcgctcctaccagcgtaaaaggcggaaggtcaaggcggacggagcgggcggacgggccttttccaataacgatatcaaggcagaagtcctccatcgccgggtacagcacttcttcgattgaccggttcagtctgtgaatttcgtctataaacagcacatccccgggttcgagcgccgtcagaatggctgccaagtctcccggtctttcgatagcggggcctgacgtcgtccgcatctccacacccatctcattggccacgatagacgcgagcgttgtttttccgagacccggaggcccgtataaaagaacgtggtcaagcgtttcctgcctcattttcgccgcatcgataaacacgcgcagattttcttttaccttctgctgcccgatgtactgggcgaggttctgcggcctgaggctttgctcgattattgattcatggctgtctgcttcacttgaaacgagccgttcatccatgaacatcaccttactttaataatttttgcaatgcttttttcacatattggtctgttgaaagcgccgtttcctcttttaagtgaggaagcacttttttaatttctttttcggcgtagccgagtaccctgagcgcttcaagcgcctcatcaagcgccgtttcagcctcttgtttttcaatgcgcgcttcatgattgaacaggttgtcaatcatttcaggcacgacatcggccagtttgcctttcaaatcaagaataatctgccgtgccgtttttttgcccacaccaggaaatttcaccaaaaaggcttcatcttcctgttcgatcgcttcgatgacggctcccggatcaccggaaccgagaatggcgagcgcccctttcggaccgatgccggtgacattcagcagctttgtgaaaagcgctttttcttcccgggttgaaaagccatacaaagaaaaggcgtcttcttttatatgatgatacgtaaaaatggtctcttgattgcttaccttataaataaacggattcggagtgaagacctgatagccgatcccgccgttttcaatcacgatgtattggggcgatacgtaatcaatcgtccccttcacgaattcaatcacacctattcacctctttgactgcttatcattgtaacacaaaaacagccaaagtcttatagaaaagttaacgtatgttcgctttgacacttttcattcagaaaaaaaagacatgtgtaacatgtcttgcgtcaaagtcagccgctgtaagtcttaatatgatcgatcacgctctcaaactccgcttttgtcctgtacggtataccgtgttccaagtgcttttgcaatcggctttccagccgctctaaatcaatctgaaagaaagactggatcggttccgccagcgatccgggacggccgtgaaaagtggaaatgacgcccccgtctgtgacaccgatataaccgtttactttactgagcggagaaatatcatcaacatgcttacggaaaaggacgaagccttttttttgctcaacgagcgtccagccggcatatgcggcccaaaagtcctccatcgccaaaacggtttcatccgtatgctcaatgccgacatcaccgtccagatagaccttctccagctggacatgcacccgaagcggcccgtaatgctcaacctctgccccgtatgcggcgtttcctccgcaaatcaggactgctgctgataagataagcataatcaaaagacgcacaccgcaaattcgtttcaccaataacacctctttattcaatcaaactcttgatgctagtttgaccaaagatgccggtgcttaatcgttttctttctattgtctgtttcagccgaaaaaaacagccctccaaacggaaggctgccccgatgattaagcccggctggctgaaatcagtttcatttgtccgggcgtcagtttgaggcggtatcctcttacagtcagatacacagtttttgtcccgctgctattgtcatgctctgtttttttcatcccggcccctccgttacgttttatattgtttttatgataacagcgcaatataaatagcgttttaaaaatatgtaaagaaatgatgaaaaaatactgccggatggaatcatccggcagtctaagtctaacggctgtttttgttcatgtcttgaagcttcgtaaaagtcgcgttatcggtaaacacttgaattgtgcggccgtccgcgaattttttggctgcatgcttgacatgtttatcatcattttttgtaaatggatgatttgttctgacagcaatgacgactctcgtgtcagtcacgataacctgactgtcctgtacgccttttactttcttcacgcggtttgcaatttttgccgccattctgatgttttcggcattgtcgtacccattataagacatcgcggccggcggcgtattgacgttgcggccgttgtatgtgccgtccgttgttaacggaaccccgttattcggcgtattttggtaagacacgtttgtcgtatttcggcggccgtttcggttttccatcatttcagaaacaggtccttgatggtccatgccgtactggcgtctgccgttatcattatcatttgaataatacccgaccggacgtgttgtctgattgtagcgtccgtcattcatggcattatttgctccgcatgccgttaagcttgccgtcacggctaaaacgcctgcgatcgtcatcaattttttgcccaatggaaaaaccccccgtggattcatcgctgtgtgagcgttttttcgctcatgtttaggatgtgcggccgacggcgggtttaagcttgtcagttatgaccattccacatttggacataaaaaagggaacgacatacatcgttccgaaacatcaatcttcttcttcctccggccgtccgaatacttgatttggactcggctgattaggcgagacattgggatttgctccgccgtaaggcataaaatatccggcatttgcccccacattcggaaatggctgcacaggcatatttgcgtgatgatgatgagacccgtggtgatgatggtgatgatgtgaattatcatgacagccgcaatcatcatccttatattttccatcgtgatgaggcgcgtttgcgtgatgtgacggatatccgccgtaatacggcatgtgagcgtacgaagcacctccgaaaccgccataatgctctgcgttttcatgagcctggttttcatattcaccataaccgccaaatcccggatggaatccgtacgaatatggcatcggcattaccggaaagcctccaaaaccgccgaaaccgccgcctaccgggaagaacgggtggcataatcccgaacccggcagcatcggcgtcaccggaaccggacaaggacaaggcatgcacggcatcgggtaatgcataaacggttcaacggccggcatattcggaaacgggacattcggaatgtttggcatattcggcagatgataagcggcgttttcttcttccatctttccgacttcaggcgcctttggcatattcgggtaattcgcgttttccatgttgatcattgcctcctgttgtggaatgttattgtcatactccttctctttcggctcgacaaaatgagtcaccggttcctccggcttaggaggcgaccacggctgaaacagctgattggacggataatgttgattcatatcagcttccggcagcacattttcatgtttttcagggatcggcggcacatacggaattgacggctttggttcttccgctatggtgtcttcgatgtccacaactgatttcggtttttctttagcatatggatgctcatgcttatgcgcagacgttccgaagtttgcttttggttcttttctgaccggaacggcttctgaaggcacctttatcttcattccaggcataattaagtctggattgcttagctgattattcaatttttttaattcttcaaaatcaactccgtatttttcagctattttccagagcgaatcgcctttttgaacgatatgaattttcaacgttttcccctcctatgcacaaaacgtgaacggtacatttgtcattacaatacgtttcttcacactatatgcaggcgagctgggcatgatgataaaaaatttggaaaggaggggagttttttatttttacgtatggctcagcattctgtttaaagcacgaagcgcttctgtccgaaccgctttcggcactttaatgacacctttcggctcgcctttttcaagctgctcaagcgaccacaacaaatgcggaaggtcaattctgttcattgtcagacacggacacatatccggattcagtgattcaatctgtttatccggatgcgagtgaatgaggcgctgaacaagattcatttccgtgccgattgcccacttgcttcccggttcagcctgttcaatcgtatcaataatgtatttggtagatccgctgtcgtcactgagcgagaccacttcccgcgaacattcgggatgaacgataatacggatgtcagcatcccgctgccgcagctgagagatattttccgctgtaaacttttcatgtacggagcaatgtcctttccaaaggatgaccttaatattttccgggtgatcagtaagcaaacggttctgcgtcgggtcccatacggccatttctgtcagcggaatgccgaggtcataagctgtatttctgcctaaatgctgatccggcaaaaataaaattctttctttttgtttaaaagcccatttcagcacgctcctggcattcgaagaggtgacggtcgccccgccgtgccgtccgacgaatgctttaatttccgccgtcgagttaacatatgttaacggaatgatggtgttaccgtacagctcttgaagctctttccatgctttgtccgtctgctgtatatctgccatatcagccatcgagcacccggcgcgcatgtcgggcaaaatgacggtttggttatcatcggtcagcatatcagccgtttccgccataaaatgcacgccgcaaaacacaatgtattccgcatctttatttttttcggccacttgggcaagctgcagggagtcaccagccgtatcggcgaattgtatgacttcatctttttgatagtgatgtcccggaatgaacaggcgctttccgaaggaccgtttaatttcggcgacccgcttctccatttcacgggtgctcatgtttttataatggctcggcatcatttcatctgatgcagttaacacgtcaaaaatagacattatgaaaaatccccctgttctgtcgcgacatccatgctgatatcggcgctttttactgaatgagtcagaaatcccagtgaaatatagtgtacgcctgttcctctataatcgggcaatgtgtccagcgttatgccgccggatgcttccgttttgatatggcccggtgtcatgcctgcaaaacgccggacggtctctggcgggcagttgtcaaacataataacgtctgcgcctgcgtctattgcctccagcagctgttgttcggtttcaatttccacttctgccgcaagcatctgccccgccgcttttcgcgcccgctccatcgccgcttttatcgatccgcaggcggcaatatgattatctttaatcatgatgccgtcatataagccgaagcgatgattacagccgcctccgattcggaccgcgtatttttccagcattctgagcccgggtgtcgtttttctcgtatcgcaaagcttaatggacggatcatcaagacgccttttggcctcatccgtcattgtcgcaatgcctgacattctttggataagattcagaatgacccgttctcccgttagaagagccgccgccgggccttctatttcagcgagcacgtcttcttttttcatccgctctccgtcttttttcagggaacggatgcggatgtcattgtgtaaaagcccccatccttcacggataacggcttccccggcaaacacgccgtccgtttttgcgatgatcttcgccttacaatgctcatcagaaaaaatcgcttgtgacgtcacatcacccgttccgatatcttcctgaaaaaaacgtgtcagcatttgtttcagctgcagaatgtccatatttccccaatcccttcgttttttctgataactgttcctgatgttgaatgaatgatttgttttccgtgccactttttctctgccccgggaaaatcagcgcgataatgagcgcctctgctttcttcccggataagagcagaggacacgacgagttgtgcagtctgccataagcaggatagttcggcttgttctattgtgatatccttcacatttatatgatgcacagatactttgttaagccaggatgccagcgcctgcatgttttctttctccctgatgatgccggctccgcttgtcattttggcttggagcatgtgaagcgttgtatccggcacttgtaagatgacgtcagatttcttcgaagctttttgatatcgtccatttaatggcgtttgcgtgatatgttcagcacatctttgtccgcttgccagcgcttccagaagtgagttgctcgcaaggcggtttgccccgtgcaaacctgtacaggcggtctcgccaatggcataaagatcaggcacagacgtttttccccatgtatcggctcttactcctcccattaaaaaatgcattcccggagctacgggaattccgctttcaatatcaacacccgctgatttacaaatgcctgatatggtcggaaagcgtttgttaaagtcagctatgcggctgcaattcataaaaacggggttttctttcattatttcttcaaaaatcgcccgtgacacgacatcccgcggcgccaaatcttcaagtgcgtgtctgcccgccatgatcctgcggccggagcgatccgttaaatatccgccttctcccctcactgcttcagaaatcagcccgtacgcagtcccgcttttcacaaggagggtcgggtgaaattgggtgaactccatatctgtgatctcggctcccgcacgaaaggcaagagtgatgccgtcgcccgttatggaggaatcatttgtgtgatactgatacagactgccgcagccgcctgatgccagcactacacaatctgctcttctgtaagaaactgaacctgaagcatcctttacggcaacgcctgcgcaccgtccgtgttcaatcaaaagatcaaccgccgtttcgtgttcaatgatccggattccgtccctcagctgctgaagcagaaacccgaccaaaatccgcccggttgcgtctcccccggcgtgaagaatccttcttttggaatgagcgccttccctgccgagacaaaacgttccgtctgatttcatatcaaatggaaattgatcttctatcagcctgtttatcatactttgtccgctttgcagcaaatgccgcacggctgtcacgtcattgtgcccgcatcccgcatacagtgtatcgtttacatgggattcaatggagtcatctgttgcgtatgaaacggcaatcccgccttgagcataatgcgaattgctgttcgttacgtttcttttcgtaatgacggtcacttggtatgacggaggaaatgaagaagcacaggcgagggccgccgtccccgaaccaatgatgataattgttttttcagacatacatcaccctcctgttttatttacacctgtcttgacacctatatttacacaacgataaaataaactcaagctttttttaacagaaacggataggagacggcctgtatgatttatcttgattacgcggcgggaacgccattaagcaaagaagccgctgaagtctttcagcagctcagtacagaggtatacggaaatgcaagcagccttcatgacgccgggggaagagcggcggatgtgctggaatattgcagacagtctgcaggaagattgatcggcggtgcggcagacggcatttattttacaagcggcggcacggaagcgaacattctggccgtccaatcattgctgcatggtctccccgcaggcaaaaaacattttattacgaccgcaatggagcaccattcgatccataatgccgcggcgtttttagctgatcagggcattgacgtcactgtcatttatcccgacaaaaacggccttataaccgaggacattcttgcggctcatgtgcgtcctgacacggggctcgtttccatacagcacgccaattcagaaaccggcctcatccagcctgtggaacgtctggccgcttttctccatcagagaaacatttttcttcattgcgattgtgttcaaagtttcggcaaactgccgattgatgcggatcaggcgggaatcgacgccctttccgtctccggccataaagtatacggcccgaaaggcaccggggctgtttacattcggcccggcatcagctggaagccggtttatccgcataccgtgcatgaaaacgggttcaggcccggtacggtgaatgtgccggctatcggcgcttttaccgcggctgcggagtatgcggtgaaacacatggagaaacaccgtgagcacgctgacaggctgaggaattatttttatgaacaaattcggctgcagggccttcccatttcattttcggaggaagaaaccggcggtgaatgcctgccccacatcatcgggtgtttttttcactcctttgaaggacaatatgttatgttagaatgtaatcgtaacgatatttgcatctcaaccgggagcgcatgttccgcaggcagtcaaggcccttcttcagctatgaaggcgctgaggaaaaccgaacgggaagcgcggcagtttttccggatctcattcggaaatgaaacaacatgtgaacagcttgatatgctgatacatacattaacggcgctatgggagcaaaagaaaggagaatcagcaatttgacagaaggaacgaagctcacgggggcgaaaagacgcgacatgctgcttctttggctgaaagaagccggctcaccattaacagggggcgaattggccaaaaaagcaaatgtctcaagacaggtgatcgtgcaggacatatcactcttgaaagcaaaaaacgagccgattatcgcaacaagccaaggctatttatacatcagcatgaacgccggcagcgaaaatcatgttgaacggattgttgcctgtctgcatggcccggagcgaacggaagaagagcttgaactcattgtcgatgaaggtgtcaccataaaggacgtcatcattgaacaccccgtatacggcgatttaaccgccgccataagagtgagcacacggaaagaagtcaaacaattcatgaaccacattaactcgacaaatgccgcgtacctttcacaactgaccgaaggcgtgcatctccatacgttaagcgcaccgacaaaagagcggattgaccaagcatgccaagcgctggatgaggcagggatattaataaaagattaaaaaaaagccctctgaaagggctttttttatatggaataggattgatatgttcccagaagcttgacccggcagccgagggcttccatctcttgaacggcaccgggaatcagcacctgatccatcgcctgttcaatatcaataataaagaaatagttgccgagacccgtttttgtcgggcgcgattcgatctttgataaattaaggtttctccatgaaaaagcggacagcaccctgtgcagcgcgcctgattggtcatcttggggaagcgtcaccatcatcgtcgttttcggccgtgaagacagtttcgcactcacttcaaatgatacgtctttttcaggtgaaagaatgacaaatctcgtgtggttatcctgataatcctgaatgtcccgcctcacgatgctcaatccgtatgtagcggccgccatttcatttgcaatcacgccgatcggaagttccgggtgctcactcacatacttagcagccgcaccggttgacttcgcatactcataaggaacggccgaaaaatgccggtgaagaaatttgtggcattgcgcaatcgcatgtgaatgagaataaattttctcaagctgtttccactcattttctttcgaagggtgaacgagcaggtgctggtggatcggcagcgtcatttcccccacgatcgcaaggggctgctcatgaattaagtagtcaatcgttaagttaacagagccctccagcgcgttttccaagggaacaaacgcaagatcaacttctcccgcgaccgccgcatccatgcatgccggtattgtatgataaggtgcttgtgtcacgctgttttgaaagcaggaactgactgctagatgtgtaaatgtggcttctggccctaaataaccgactttcatgtttctcttctctccttacgcgcctgaccctaagatctcaactttttctataaaatcaaattttctcagtttattcattaacgtatgaatgttttcttccattgcggacgtgctgattgagagcgtgacatttgccctgccctgaagcggaatcgtctggtgaatggaaagcacgttgcttcctgagtcagctaccgcctgcaaaagctgtgataatgcgcctgaccgatcctccaaatgaaagaaaagtgtgattatttgttctttaaccatggtgtaaaaagggaaaaccgcatctcggtatttgtaaaaagcgcttctgcttaaatcgactttctgcacggcatctgcaactgattcagccttttttctgtccagcagctttttgacttcaagggttttccgcatcgcatcaggcagaacgtcttcacgcactaaataaaatgtctcttctttcacctgcacccctccctcttacatcagagagcctgcatcgcaagctctccgtctttttaatcaataaattcaaattcaaattcaagaagccggatgatatcgccatctttagcaccgcgttctctgagcgcttcatcaacgcccattccgcgcatctgtcttgcaaaacgcttgacggattcgtcacgggagaagtcagtcattttaaagaggcgttccaggctgtcacctgaaagcacaaatgcaccgtccggatcacgggtaatgttaaatggaatttcttcgtcttccatcgtgtacatcacgcggttttccgccagctcttcttcatcatagagcgggaattcaggcgttgtttccagctggttggcgacttcaaacagaagatcgcgaagcccttctcttgtcaccgcgctgatcgggaagactgggtggtcatcctgaagcttttctttaaacgctttaagattttcagtcgcctcaggcatgtccattttattcgcaacgataatttgcggacgctccgtcagccgcaggttatattcactgagctcctgattaatggtcacataatcctcatacggatcacggccttccatcgctgacatgtcaatgacgtgaacgatgacacgcgtccgttcgatatgacggagaaattggtggcctaagccgaccccttcgtgcgccccttcaatcaggccgggcagatccgccatgacgaagcttcttccgtcatctgtttccaccatgcccagattcggaacaagcgttgtaaaatgataatcggcgattttcggctttgctgatgaaacgacagacagaagcgtagattttccgacgctcgggaagccgacgagacctacgtctgcaagcaccttcagttcaagcacgatatagcgctcttttccgggctctccgtgctctgacagctgcggtgccgggttggccggtgtcgcaaagcgggtattcccgcgtccgccgcgtccgccttttgcgatgacggcgcgctgtccgtgttcagtcagatcggcaatgacctgttttgtgtcgtcatctgtcacgactgtaccgggcggaactttaacaaccatatcttccgcgtttctgccgtgctgatttttagacatgccgtgctcgccgcgtatcgctttgaaatgccgctgataccggaagtccataagcgtgcgcagtccttcgtccacctcaaaaatgacgtcgcctccattgcctccgtcaccgccggcaggaccgcctttcggcacgtatttttcacggcggaacgcaaccattccgttaccgccgtcgccgccttttacatatactttcacctgatctacaaacataatatcctccgttctaaaccgtaaaaaaccgctagttcattccaatttcggccacacattcatggccggtcagctcaaattgcatgacatcaaagtcctcataccgcgatttgcgaaattcatcaaacacatctgcattagcaatcgttccatgaaaatcgagatatacaataagctgtctgtcagggtgatccgtctgcagcgatacggtcagatgattttcactttcattgcttaccgccagcccgaacagatgaaacagttttctcatcaggttcgacagcttttgatcatatgccgataaatcttttatttctccgagcacttcgtattcgagcctcatataacgggacttccaattaaatgtcaaaaagtcaaacgccaagtgcggggttttcaggtttgagagctttgattcgtgttttgcatctatgaccatttcgtcaattatttcaacgaccctgtcatacttctgcaaacttaagtttccttttatcagctgcagcttattcatccaatcatgacggaaatgacccattaattggatcagctcattgatcagagccgcctcgcttacaggttcttcttgtttcttcgatacatccttcattttcgcactcccaatcgtttaatttctttttaggagtcttgataagtgtgtactatgaattataacagagaaggctttgttagaaaaacacttgtttttcctggttcatcatgttcctttttcggatcgcatgcatgcggatgccaggcagaaacatttttggtatcactgcttggggaacatatccagtgggtatgagaagctgatgtcctcattcaaggcggggttcactcacgcgtcctctgcttttcattcttgatgttactccgcttactgcaaaaaaaactccagtcaacgaccggagttttttgtgtcattattgagctacaggatatacgctcacttttttgcggtcacgtccgaaacgttcgaatttaacagttccgtcgattttagcaaaaagagtgtcatctcctccgcggcccacgttttcacctgggtagattttcgttccgcgttgacggtaaaggatagatccgcctgttacgaattgaccgtctgcacgtttagcgcctaaacgtttagattcagagtcacgtccgttctttgtagaacctacaccttttttagaagcgaaaaactgaagatctaatctaagcatgtaactcacctcctatatttggtttgcagtcaaccgtaagtgttcactgtaatcccgttcgatcgtttcaagagaaacaatcatgccttcaatcagcagctgcgctttttgcaaagcttcctgatcagcggattcagggaattcaaagtagaaataacccccgtcctcgcctatatcaagaatcggttcgagaggagccagcgcgataaccgcattgaccgctccgaaaacgacagccgtgaccccggcgcatacgagatctcgtccatgttcagcaaaatcggcatgtcccgtcatttcaaaggacaaaatgcccccgtcattccgggatcttcgaattgttgcctcaatcatgcttacgcgttgattttttcgattgtcaatttagtataaggctgacgatgaccttgttttttatgaacatttttctttggcttgtaacggaaaacggtgatttttttcgcacggccttgtttttcaactttagctgtaactgtcgcgcctgcaactgttgggttgccgactttcacgctgtctccgccaacaaacaatacgtcttcaaacgtcactgtttcacctgcttcagcagcaagtttttcgatgtaaacagtttgaccttcttcaactttgatttgttttccgcctgttttaatgattgcgtacattctctgcacctcctattagactaagactcgccagcaacagggggctttaaagctcttatcacctgtcccgagcggttgtagcattggtgctacatccataacattaaaaaatatatcagaaccaaaaggatatgtcaatctatttctagtaaggcagcagcaggtcttccatggaggaatctgtccgtttatcggcaaaatatgcatgaagcacttcattttcatcaagctggctgagcttctcgccggctttttcaatgataatgggatgtttgcagccccgtttgaattcagccatgacatgctttactttggcatcggccgcgaccgtcaaaggatgcagcatggcgacatcgcggtttttgccgtaatatctctctaaaagaaacctcagctgaatataatgccgctttcggtattcatcccataaggaagccgcgagaaagacgaacagcacccatgcactgacctgcagggggacggccagtacaatccagccgcagagcaaaagcgcggaaacggccgaagtctgcaggctgaggagatgcgctttttgaaaagccatttgtttagaaaagtataagaacacgaactttccgccgtcaagcggccagatcggcaacagattgatcaaaagaatggagagattataaaaggtaaacatctcaaatgtctgctgacttgcaaagccggagatgaaaaggagccaggctgccgcctgaagccacacgtgctgaagcgggcccgccagaatgacagcaaattcttctttcagcggccggtttccgtgctcttccacctcaaccgtcccgccgaaagggagcaaaaagacgcgtttaatgcgccacgaaaaaaacacagccagagcagcatgccccagctcatgaacggatacgaccagcaaaagacacaagagcgctttgatgtgccccgtcagaaaaccaagccccatgataatccaaagaaaaggatggacatgaattttgaaaagaaggctgagccatttattcatcaaatgtgatcacctggatcggatctatgaatttatcgccatcctgaatcgcgaaatagtactggcctttacctttatcgctgagcttgatcgaaccgatctttttccctttatcgataaagtcatacaatgatacgttaacatctttgagccggccgtaaatgctgctggtattgtcggcatgctgcaccttaaccgtcagccctgtttttttatctttgctcacttccataatgtacccttcttttacgctgtcaatggcttcactggccgtttcgacaacgacgccttctccgttattttgaaagttctgctggattttccccgcggcaggaacggccatctcctggctgaccgccacctgaccgtctttcttttttgttcccggagtgagaaatgcgagcgggtttccgaaggaggatacaaaccaattgtttacggcagcaaactgaaattctttttgaaaagtctgtgcgatcgccggtttgatctgactcagcggctgtttgtcagttttataggcgatagcggaaaccagcacgagacaggcggccagcaggcattttaaaataatagaattagcgctgatcaatggatgccgtccgttgaattcgggcggatgttccgtttgatattcatagttcggaagaagcccgtgcttttcctgctccttggacgtctgccatgcgggaggcttctgcgtctgggcgttatgcacgaaagtccgttttgattctgggcgcggttttctccttttggccagtctttttctaatttcatcagctctgtgactcatcgctatcatcctttgcaatcgttgggtttgtacatcctatgccttgtccattgcaaatatgcgccctgttgaaaaacaaaaaagacctgataagctgggcttcatcagatctttgtattctagtatatttatgatcgcacgccgaaaaatgacttaattttcgccatcatccctttttgctgctcttcaagcacctgcaaaggaacggattctcctaaaatgcgccgggcgatattgcggtaagcaatgctggcgcggtttttggaattcatggcaatcggttcgccgatatttgaagctctgatcacttcatcatcgtcagcaacgatcccgaggagatcaatagacagatgatgaacaacctcatccacatccatcgtatcaccgtttttcaccaggtgatttctgatgcggttgacgatgaggcgcggcggttcgatatcttcctgctccaaaagtccgataatgcggtcagcgtcccgcactgctgatatttccggcgtcgtcaccacaatcgccttatcagctccggaaacggcatttttatagccttgttcaattccggccggacaatcaataatgacgtaatcaaattcctgcttaagctcctgcacaagcgatttgatctgctcagggacaacagccgttttgtcgcttgtctgggcagccggcattaaatgaagcagatcatcaaaacgtttgtctttgacaagcgcctgatgcgtcttgcatctgccttcaattacatctactaagtcgtaaataattctgttttcaagacccattacgacatcaaggttgcgcagtccgatatctgtgtctaccaaacagacgcgcttccctaaaatggctaaggcggtaccgaggtttgcagatgttgttgttttacctactccgccttttcccgaagttattacgatagcctcacccaatttcacattcctccctcaagccttgttagatcaggtcttaaatgagccaattgctgaaggcgttcaatgaccatatttccgtcagtatctaaataagcacattccatgtcgttccctttttgaatgtggtctggggagcgatttaacacgtgattgatcctcaattgtgtcggcatcatttcggatgcggcgatcacagcccggttatttccgttataacccgcatgggcaatcccttttaatgaaccgagaacaaatatatttcctccggctctgatcgtaccgccgggattcacatctccgattaaaagcaaatctcccgtgacatgaagcacctgacctgaacggacaattttagaaacagaaacaatttcctgctcctctttcatccgcttcgcttcttctttggcgatgacttcactgtcaattgaatgcacgactaaatctttctttgacgcgatcagttcagtaagctgctctgcctgttcctgatacagataccgatgcccgagtttaatatgaacactgattttttggcctttgccatcagtatattgttcaattgacagcatattttgaagaccatcaagtagctcatcaaaagaacacgcatcatcaagatgtaatgttaagccgttttttgttccttttattgttacatattgctgctttttggtcttcatcaatgttcacctcaacaacatactcttttcgtcaaaaaaagataaaatcctttttactcatctcttaattctttcttcagacttatataaaacagcctaaagggcaggactaatataatggctcccgcaatattcagcacagcagtcggcaaaaaccgctgaatgacaaaatcgttaaacgtcattgtaccgctgcggattaacgtctgaatgccgtagacgtaaaattcaagcacacatacgctcagcacagcgaccagaatgaccatcagggcgtttgtctgcaacaccttaaacgctttggccgccaggtagcataaaccggcaaaaccaaacatataaacgcctaaaacacccgtataattgatgtcataaaggagtccgaaaatgaaaccgtagatcaccgcatgcttttggttgatataagcggacataaaaatcagcgcgagcaaaagaaagtgcggaacgacctgctgctcgtcggaaacgaacggaaaatgcaccagatctgtatagatgctttccgcacaaaagaccacaatcataatcaaagggagaaggaaacgtttcacgatccttcctcccctgttgctacgcttcggttcacgacgatgacatggtcgagatcatacagatccgcagccggtttaacgtaagcgattttcgtcaggccgtacgcatccgattctacatctgttacttcaccgaccgtcagcccttgaggaaatacgccgcccgttccggaggtttccacaaggtcgccttttttcacttcacgtttgtcatccggttcaaggatggtcattttgagagtctgcttctttttgtcatacccctcaattaaaccgtagcctttgcttccctttttgccggagattttggtggccactctgttattgcggtcaacatcgctcagcagctgaacggcggatgtgaaactgttgagtccgctgcttttgatcttcccgacaagcgcacccttttcgtttgtgacagccatgtccttggccactttctgcttcgttcccttattgatcatgatctgcttgtaccattgatcaggatttctggcgataacggtcgctaaaatcggttcatagtcggaaatcgacttgacatgcccgagttcatcacgcagcttcttgttttcatctttgagttcttggagcttcgcttcatattgcgtctgtccgtccagcttttgtcttaagcgttcgttttctttgtacgtgtttttcaggtcttttatgtccccgaagaaccctgcaaaatattcggcaggcgtgtgaaaaatattttgaaatactcccgtcgtatcaccgatcagcttttcaggccaggtggtattacggccgttcttcagcgagaatccaatcatagccaccaatatgataatacacagaagtaatagcattaaccgtttattcggcatcgtgatacacctcttctatttaactcctgattatcttgtttttcctttgaaaagatggatgtgctccagtgcttttcccgtgccgatcgcaacacaatccagcggatcttcagcgataagaacaggcattttcgtttcgtcgctgatgaccttgtcgagattgcggagcagggcgcctccccctgttaacacaatacctctgtccataatgtcagcggccagctcaggcggtgttttttcaagcgtgctcttcaccgcgtcaacaattgagagaactgtatcacgtagcgcatttgcaatttcagttgccgtaatttcgatcgttttcggcagacctgtcaggagatcgcggccgcggatttccattgacgtattttcttcaccggtttccgctgagccgatttccattttaatggcttccgcagtacggtcaccgatcatcagattatatgtttttctgatatagctgatgattgagtcgtccatttcgtcaccggctacgcggattgactgagacgtgacaatgcctcctaaagaaatgatcgccacttcagttgttccgccgccgatatcaacgaccatgctgcccgtcggctcccataccggaagattcgcgccgattgctgccgcaaacggttcttcaatcggataagcgtcacgtgcgccagcttgtcttgtcgcgtcgataaccgcccgttcttcaacggcagtaatacctgacggcacacacaccataacgtacggctttctcgcaaacaatcctttatttttcacagcctgattaatgtagtatttcatcattgtcgcagttgtttcataatcagcgataacgccgtctttcatcggacggagcgcaaccacgttgcccggagttcttccgatcatgtttttagcatcgttaccgaccgcaacgattgatttcgtatccgtttgcagagcaaccactgacggctctctcactacgattcctttacctttaacaaacacaagcgtattcgcagttcccaaatctataccaaggtctcttgtaccaattccgaacatatgtatgtatcttcctttcttaaagcaaaaataccctaaagggaaaaactcataaaatctattatatcttaaatcaacgaaaaaaaaagtgttacaaatatcctttttcctttaaactcacaaattttttgtcaccaatgaccaaatgatccagcaactcgatgccgattaaatttccgcactcaaaaagccgtctagttacttctatatcttccctgctcggtgtgggatctcctgaaggatgattgtgaacgcaaatgaaggacgcggcggatcgtttgaaagcttctttaaacacctcccgcgggtggacaatagatgaattcagacttccgataaaaatggtgcgtttatgaatgacttgatttttggtatttaaatataaacagacaaaatgctcttgggataaaaagcgcatatcctccatcacatacttcgccccgtcttcgggagaacggatgacgcaatgctctccggcggatgtcttatgaatacggctccccagctcaattgcagcaaggatctgaacggctttcaccgtgccgattccggggatgctggaaagctcctgggcagaagcgccttttaacaggcgcagcccgtcaaacgtccgcagcagccggtgagagagattcatgacggactcatgtttcgttcccgtcctcagcagaatggcgagcaattcattgttagaaagatgttcggccccgcaatgcagaagccgctctctcggtttttctttttcggggaaatctcttaattttaacggcagatcacggatgatcaacccctccttgttccccttcccggtttgaacatcaagcttttatattaaattctttcagggctctcattgttttagcgacaggcagcccgacgacagaatagaaatcaccgtctatttttttcactaaaagcgcgccttttccttggatgccgtatgcacctgctttatccatcggttcttttgtttcaatgtagagctgtatttcgtcttcactgagcggccaaaatgtcacttccgtcttgtcacagaacgtttctttccggtcatgcgtctgaatgctgaccgccgtaatgacttgatggcttcggccggaaagcctccgcagcatgtgtgccgcttcttctctgtcacgcggtttgccgaggcattcaccgtctatgcacaccatcgtgtcagccccgataacgactgcatcgggattttcggccaatacagcaccggctttttgctcggccaaacattggacgttttcttccggcgaaaggtttcgatttaatttttcatctgtgcggctcgcaataatgctgtaaggaatctgaagaagattaaggagttcttttcttcgcggagattgtgatgcgagtattaagcgttttgtcatgattgtcatcctttcagggtttgcttaagaaaaaaagatactcgtctatcctaccaaatcaagcggacaaccacaatttcagaaaaataactttttgatgacaaaataaaaaatcccgccgcatgacgggagaaagaaatattattttacaatgcttaaaagctctttctgggctttccagccggattcggaaccggacgtttccagttctttcagcgcttgaaggacggcctctttctgctttttgtcagcggcggctgcgccgtctgccgctttggctgcttcagccacatctgattttgaaatatctttgccggtaattgctttggccgagagctcagatgctagtttaaaagagtcttccaagcctgaatcgaccgcaaagctgagctcttttccgccccatgcctcaaaatcatggtctatcagcgcctgacccaattgctgtgataagcttttttccgctgcaagaccggcgatcacgtatgtgtatccgtcttcttttgccagagagacggccgagtaacctttttcagtcagctggtcaacgagcgtttgcgctcctttttctgatgaaaatttaccggcctgcaccgcatatgttttatagtttccctctgactcttccgcatttcctgtggcgcttgtttcttgcttgtcttttgatacatctcccgctttcaccgtctgcccttgtgaacctttgtcggcggaagctggagcagcggcttctttacttcccgacatatttaaggcgacgaggccgagcccggtgcctaaaacagccgcaacggcaattgtcgtgaccgctttttttacgggagaagacggctgcttctttttcggaaaatgagggcctgtgtttttcttttgatatggcgggacgactttcgggtcatcttcaaatacctcctgattcttctcatcatcccaattgaaatcttcttccttcggatcttcatgggaagctgcgatctcctgctccgccttctttgtttcttcccaatttgaaaatgtgacggttttctccccgccttcattcacatcttcttgtccatacatcgtttcttcttttccgttaatcgttactttaagggcattgtttttggctttgctgttctttttgctcttcctttttttcaacgtctcttcccccttgcattcgtcttggccgtaccttgaactgatcatggttcacactttagcataggcgaaaaaaaaaagaacaagacttttgtcgtcttgtccaaaaaacgttcgccaaatttttcaagctcctccggaagcgagtttgatgtaaaacgaaaacagttcttcaccgtataaataactcacagcgctcccggccgcgatggcgggcgcaaacgggaaaggctgctttttaccaagcctgccgcccgctgcggcgcacatcccgtatacggctccgattataacggaaagaaagaatgcaatgagtacgagcttcacgccgagcgcaaggccgatgaccccaaacagtttcacatcacctgcaccgatgcctcctttactgacaaacataataaaaataagcagaaaaaatccgcaaacggctccggcaaaccccgcataccatgaatccagcggagaaaaaatacggccgacgatgagaagcggcagaaaaaacagcagaaccttgtcaggaatcagcatatattgcagatctgtcacggtaacaatcattaatagagacagaaataacagcgcgactaacagttctcttgagaaaccgaaatgaataccggcagccgtaaataaacatgccgtccagcattccgccgccggatacataatcgacagcttcccacggcagtttctgcatctccctttttgcaggacataagaaacgacgggcaccagctcaccccaggagagcggcaggccgcaaaaggaacaggatgagcgcggcgaaataaccgagatccgaagcgggatacggcacgctgctgtataaaaaaaagaaccgaaaatcaaaccgagcaaaaacagaatcaaaagcactcagaccacaccttttctatcaatctggctcagattgtagcatagaaaaacatcatgcctgaaatggctgaaactatattttcctcataaaaacacccggcaaaaccgtaaaatggtttgccgggtatccgaagagctgtcagataagccgctttctcatttctgaaataaaatataaggatccggtaatgatgatgacatcatccgttccgtctttttgcttaatccattctgtcacactgtccgggttttcatcgaagcttttgttcgcaagactgcttgcattgtaaaggtcttttgcgcttgaagcacgcggaaaatcaaatgatacaaaatgaatggagtctgcttcggtttcaagctttttaatcatttcctgatacggtttgtcttttaatgcgctgaatacgacatggatgtttttatcagcaaagcgctgcctgatcgtttctgtcagcgtttcaacgccctcttcgttatgcgcaccgtctgcaaatactaaagggcggctttgaagccgttcaaatcggcccggccacgaagcctttttcagaccgtttcgcaatgcttcttcagaaatggcggcgactgtcaggcgattcagccattcagcggccaatatcgccaatgccgcattctgcctctgatgaatgccgatcagcgacgtttgaatgttatcatagcagttcgtttccgtttccagcgaaaagctttcaccgtacggaagcgccgcttcattaaaaagtctgcacgttttatatagcggctggcacggagcctgcttcttttcggcttccgcttcaataacgccgagtgcttccggctgattgacgcccgttatgacaggaatggcttttttgataataccggctttctgcccggcgatctcctcgatggtattgcctaaaatcgccatatgatcatgcccgatacttgtaatgaccgacaagagcggtttcactatattggttgaatcaaatgtgccgcccagccccgcttcaaaaatgacaaaatcgatatcatcccgcttcgcaaaatataaaaatgcacacgctgtaatgatttcaaattctgtcaccgttccggcatcggtcttatcgagctcatcgactatcggttttatttcattaacgagcgctctccattcctcatcagaaatcggcgtgccgttgacgctgatacgctcattgaacgtaatgatgtaaggagatgtgaatgtgccgaccgtataaccggcttcctgaagcacggatcggataaaagagacggttgatcctttaccgtttgtgcccgccacatgaatggcgcggatgttcttttccgggtgttccaatttttccatcagcctttccatacggagaaggcccggcttaacgccgaacttgagtctgccgtgaatccagctgatcgcttctttgtacgtcttaaacaatgaaatcccctcttttatacgacaaggcggtttcttaggaaaccgccccgctggtttatcagcctttcagctctgcaatccgctgccggacagcttcgcgtttcgccgtgtagtctttctcttttgcgcgttcttcttcaatgacatgctcaggagcttttttaatgaatccttcgttgccgagttttttctgaacgcgttcgacttcttttgtcagcttgtcgaattctttttgcagacgggcgatttcctcatcaatgttaatcagcccttcaagcggcagaatgacttccgctccggtaacgactgctgtcatcgctttgtctgccgcagtgatatccgtcccgattttcagcgtgctcggattcgtgaaacgctcaacgtaagaacggttcttctcaaggcggccggcaatgtcttccgtagatgttttaatgtaaagctcaacctgcttgctcatcggggtgttgacttcgctccggatattgcggacagaacggattaattcaacaagcagtttcatatcagcagccgcctcttgatccgtatgttccggcaccggaaccggccaagagctgatcgtgattgactcgccttcatgaggaaggtgctgccaaatttcctccgttaagaacggcataaacgggtgaagaaggcgcatcgtttggtcaagcacgtacgccaggacagagcgggttgttttcttcgccgcttcatcttcaccgtacagcggaagcttcgccatttcaatataccagtcgcacacatcgtcccagataaagttatacaggtggcgtccgacttctccgaattcataacggtccgcaagctgggttacatcttcaatcgtttcattcagtcttgtgagaatccacttatcagcaactgatttctcaccggacagatcaagctcgtcatacgtcatgccgtccatgttcattaaggcaaaacgggaggcgttccaaattttatttgcgaaattccatgtagattccactttttcatagctgaaacggagatcctgccccggtgaacttccggttgccaggaaatagcggagggaatccgctccgtacttgtcgatgacatccatcggatcaacaccgttcccaagggatttactcatttttctgccctgctcgtcacggattaagccgtgaatcagcacgtctttgaacgggcgctcaccggtaaactcaagaccttggaaaatcatccgggatacccagaagaagatgatgtcataccctgtcacaagaacatcggttgagtaataccgcttaaagtcttcagcgttttcatcaggccagcccattgtagaaaacggccaaagcgcggagctgaaccatgtatcaagcacgtctgaatcctgttcccaattttcgctgtcttcaggcgcctcaaggccgacatacacttctttggtttctttatgataccaagccgggatgcggtggccccaccacagctgacgggaaatacaccaatcacggatgttttccatccagtggagatacgttttctcgaaacggtcaggaacaaagtgaactttctcttcttttgactgaaggtcaaccgccgcatctgccagcggctgcattttgacaaaccattgtgtggacaggtacggctcaacaacggcgccgcttctctcactgtggccgacagaatgcatatggtcttcgattttaaagagaacgcctgtctcctggagatctttgacgagttttttgcggcattcaaaccggtccatgccgttatattcgagcgctttttcattcattgttccgtcttcattcatgacaagaatccgctctaaattgtgtcggtttccgagttcaaaatcattcgggtcatgggctggcgtgattttaacggctccagatccgaattccatatcaacataatcatcgccgacgatcggaatttcgcggtttgtaatcggcagaatcaccgttttaccgatcaagtgcttgtagcgctcatcttcaggatgaaccgcgacagccgtgtcgccaagcatcgtttccggacgggtggtcgcgatttcaattgagcctgaaccgtctgctaacggatagcgcaaatgataaaacgcgccctgtacgtctttgtaaatcacttcaatatcggataaagccgtttttgtggcagggtcccagttgatgatatattcgcctctgtaaatcaagcctttttcgtacaatttgacgaatacttcacgcacggctttgttcagcccttcatcaagagtgaaacgttcgcgcgaataatcgagtccaagtcccattttggcccattggctgcgaatgaaatcagcatactcttccttccacttccatgtttcttcaagaaatttttcgcgtccaaggtcatagcggctcgtgccctgttcgcggagtttcgcttcgacttttgcctgagtggcgatgccggcatggtccatccccggaagccagagcacgtcatagccctgcatgcgtttcatacgcgtaacgatatcttgcagcgtcgtatcccacgcatgaccgaggtgaagcctgcccgtcacgttcggcggcggaatgacgacagaatacggctgtttcgtttgatcgccgcccgcttcgaaatattttcctttcagccaaaaatcatagcggcctttttctatcgcagacggatcatattttgtcggcattgtttgttcgtttgtatccataataaccctccagcatgtttagaaatggctgagcaactaaaaaagagccttcatcctgataaaggacgaaaagctctttcgcggtaccaccttttttcatgaacagatctgttcatgcacttaaacggataacgggtgcggcccgaatttctctactgtatgttcaagaaattatgctcccgggcgaccttccaatgagacggcataagaagcctttcagcacagtagcttctctctcttcatgcgtctttcttgtactcttcccgttcaaagcaggtgtattctatcagctcatgatcttatttattatgttctttattatagtaaaagtgtttttgattcgtcaatcatcttttccaaaaaccgctgccgtcatacataaatgggcatgcaccccgcccttttccgcacatacgatacaaagaaaggcgaatgtgaggaggaattgccgtgaaaaaaagattcaattcttattcgctcccccagtgggccagacaggtccgccttgtatccgcgcaagtcattataccgattacgatctttcagggaatcaggacgattttctttccgacgacttttgatgtccttctgcttgccatcctgctgtttttagcgtgcgccctgcatttggaatggatataaaaaaacgagtcccgttatgaagaggactcgttttccgcctttatttttttctcctgctcaatctgatacaccttcatgagaaatggttcaacatttttcatctgccaaaacgcccttaataattgcgagcactcttctttttcagagcccctttgagcggtctgataccgtttcagcactttgtacatgccggacggataagccatatagctgagaaacaggctgatttccgcttcacggagcggaaatgatttatgatacgtataaaaccagtcaagacactccggacacgctttcggatagcttctgaacaatctggaataaaagccgagcagatcattttgcggagggcccagcgcagctttctcgaaattggtgaaaaagcccgctcccacgtcattatatagaaaatggcggctcgataagctgccgtgattgatcaccgctctcgtcttatcaagatcctttgccgcttcgaaccactcctccagacgctccagagcaaaattgacggcggacaccgtttctgtaagatacgtaacggcctgcagttcaaaaggagaaaggtaccactctttttccgcccggtcggcaaattgttcatagacgagcttatcattttcccaatctcttttcgttacttcataaaagccgctgatatcttcagtactgatttggatgtcccgcacggtcgcggagtggagcttcgcaacctctttaaaaaggtaaacatgcttttgatccagttcttcttcctgatcgtactgaagccaaggcattaaataataagaatcctccgtctggcttccggcaaaaaaatcgcctgcatgcgtgcggtagatcggaacaaatgaacggtagcctttctcctcaatctcaatcatatgatccgtaaaatcattgctgcgggccggcttgagctgtttcaaagcaaaaatgccgtggtttgagtagactttccatacatgcgggctgacaggctcaatatactcagccgccagcccgtattcctgaagcactgattggactgcttccattccattcaccacatttttacggcctctttgtgcttacgcatggctgttattatattcaggtatatacagaagctgaccttcttcaagctcgtcatcaaacgataaagaattcgttctgataagctgctgggatgtgatgtcatatcgttcgcacacccgatcgattgtatcttgctgctgtacaatgcaaattttcattctcgaaaacttttcttcttctcttgtaaataattttgtcaaataatgagagttgtcattttccttctgatccgttttcggtgccggttcttcattctctctttcggacttaagcggctcaggccgttcagatgccgccggttcttcaggcggcagtttggaaaactgaaaagacaaatcaagaggttccccggtttcctcctccggctgcgccatcttccttacctcaatttcaaacccttcatcagcctgggtttcttcctcaagaaacttaggagcgctgtaaaattcctcttcccgcggttccggaacgaactcgcgataagcgggctcctgttcttcttcaaaaaccgcaggctcctcttcgtcttctgtctcctcttgatcactctgacggagaagcggttcggcctctggctgctcttctatttcaagggcgggctgttcctcaacctctgttttttctgcatgcggggtcagagtaaaagcaggggaaaccggttcaacatcatcctttggctcttccagcacttccgctgcatcatcctcagatacaggctcattcctttcagccgacatgattgcaggctcctcagcttcttccggctcttcttcgtcttggacggcagcgggaggaggaggctcagtaattgaaacaggttccggcacctcttccagcctcagaacaggggcggtttcctcatcctcctctttttcttcttcctcttcctgcctgagtataggcggagtctcttcctcattctccacggtttcttgtattgcttcttcttccgatacactcagcggctcttcaggaatctgacgtatcattaattctggttcattttcttcctcggaacgatgttcagcaagattgatcatttcttctctggaaaattcaggcgccacatacagagggatttccggctcttttggctcggtttcctcaagcagtccttcaattgccaaatcagcctgaatggttaagattcttgaatccgtcaactgataatcaaaggcatcaataaaaacgaaaacatcattgaggtggctcactttatttttcggaatcgtgatgtctaccgggaaacaatgaaggagctctgcagtgccatcctcccttgccctcacttcctctacatgtctcagctctctatcaagctcttcgaaatgactgctgtgatctatgttgtactcgccagtaagttctaatgatcctttaattgagacataatcatttacttcctgcaccctgatatcagggtctaatgaaatcgaaagtaattcagaaacttcctgtcctttttggaaacagattgattcttcaacagaaaattgcaaccggtgattatgcggcaagttcatatcctcctttcatctaatccatacaattagatgtcactaaaggtgtatgccgcaatccggataaatatgataaaggaggcattgaaaaaagccgatacaagacttgcttgcatcggcttttcggtatcagcggctgatagtctggaacactttctcagcggcttgaatggttttttcaatatcctccattgtatgcgcagtggagagaaacaatccttcaaattgagacggcggaagaaatacgcctgcgtcagccatccctttataatatttggcgaacagctttaaatcagatgatttagctgtttcatagttaatgacaggctcatttgtgaaaaagaatccgatcattgagcccgcacggttaaacgtgtgcggaatgccatgtgcttcagcggctttggaaatgccttcttcaagcatatcgccttttttcacaaattcttggtaagattcaggtgtgagctgctgtaacgtctcaagtcccgctgtcatggcaagcggatttcccgacaatgttcccgcctgatagatcggaccgctcggagcgattcgttccatgatttcggctttgccgccatacgcaccgacaggaagaccgccgccgatgactttgccgagacacgttaagtcaggcgtcacgccgaaatatccttgcgcacagttatagtccacgcgaaaaccggtcatgacttcatcaaaaattaacagcgcgccattttgttccgtgatgtcacgaagcccttgcaaaaagccttcctgcggcggaacaacgcccatattgccggctaccggctcaacaatgaccccggcgatatcttcaccgtactcacggaatgcgagtgcaacgctttccaagtcgttatacggaacggtaatcgtattcatcgcgattccttcaggcacacccgggctgtcaggaaggccgagtgtcgccaccccggatcccgctttgatcagcagcgaatcaccgtggccgtgataacatccttcgaatttcaaaattttattgcggccggtatatcctcttgccagacgaagagcgctcattgtcgcctctgttccggagctgaccatccgtacgatttcaacagacggcacacggtcaatgaccaatttggccagttcgttttccacttcagtagaagctccgaaacttgttccgttttccgcgacctttttcaggctttcaacgacgcggtcgttggtgtggcccaaaatgagcggaccccagctcagcacatagtcgatatattcattgccgtcaatatcaaaaattttcgatcctttgccgcgctgcataaaaatcgggtccatatcaactgatttaaatgcgcgcaccgggctgttcactccgcccggcatcagtttctgtgcttctttaaaagcggattttgatttttcatagtttctcatctgcctcagctcccgtcaaatgaaattcttattcagcaagccattttgctgcgtcttttgcatgatacgtcataatgaggtcggcacctgcacgtttcatgctcgttaaaatttcaagcaccatttctttttctttaatccagccgttttgggctgcagctttcaccatagaatactccccgcttacattataagcgaccagcggcaggtgatggcggtttttcacatcacgcataatatctaagtatgacatagacggtttgacgattaaaaagtcagcgccttctgcagcgtctgattcagcctcacggagcgcttccaagcggttggccggatccatctgatatgtttttcggtcgccgaactgcggtgtgctgtcagccgcgtcgcggaacggaccgtaaaattcacttgaatatttcacggcataggacatgatcggaatatttgtgaatccttctttgtcaagcgcttctctgatcactgtgacaaaaccgtccatcatgtttgaaggagcgatgatatcagcgccggctttagcctggctgacggctgtctgcgccagcagttcaagcgactcgtcattcaggattactccgtctttcacaacgccgcaatggccgtgatccgtatattcacagaggcatgtatcagcgattacgatcatttcaggataatgctttttaatttcagcaatccctttttgcacaatgccgtgatcgtgaaaagcctgagttccgcagtcgtctttttcttccggcacgccgaaaacgatgaccgacttaatgccgagtgatatgagctcagccatttcatcctttaataaatcgagtgacacatgataaacccccggcatggaaggaacttctttttttccttcaagcccttcaacgacaaataaagggtaaataaaatctgaagggtgaaggcgtgtttctcttactaaatctctcatcgcagcgttcgcgcgcaaacggcggtgtctgttaaatgtttgattcatcattatctatcctttcccgacatgctgcacatgacgtccagcatgccttcaatcgtataggtgtcaggcacatgggatgagatcccgtattccaatagcgctttttccgtcaaagggccgatgctgatatagctcgcaccgctgttttccaaagtttttttttcgtctccgaccgcatgcataaacgtatgcaccgccgaagaactggtaaacgtaataaaatcaaaatgagagcgggatgcagcctgtctcagctcgtccattcctttttcatcctgaatggtattgtacagcacccattcccttatttgatagccaagcggctcaagctccgcttttatgacatcgcgtgataaattgccctttatcactgaaatgggttcggcagctgatgcgtgccgctttaatgtatcagccagacattcagccacatactcatcaggcatcgcatccgtcccggctccccgctctttaagggcgcgcgcagtcttttcaccgacggctgcgatttttttccgtcccgaaagcgcaaggccgtgctcatcgaggtaggaaaaaaagaaccggacaccgtttacgcttgtaaaaacaagccaccccggctcagaaaggtcttcccggagactgtccgcacattcacccgggagcgcttcctgaaaagcgatcagcgaagcggaaacagccgttccgccgagcgcctccactttttttcggaacggggcggcctgtcttttgttccgggtgacaagcacggtctttccttgtaaaggaaggtcatttgccatcctgatcgagctcctgttttacgctgtcgattaatgctttggctcctttttcagacatcatcgccgcacagcgtttcccgatttcttccggatcatgtcccgccgctgtttctttataaatcgtcttaccgtccggagacgcaacaagaccgaccaattcaacctcatcccggtcattgacggacgcatacccggcaatcggcacttggcagccgccttccatcgcgtgcaagaaagcccgttcggctgccaccgtgcgtttcgtatactcatcggtgaattgcgcaaacagcttcaaaagctcctcatccgactctctgcattcaatggcaagagcgccttggcctaccgcaggcagacagcggtccggttcgaggaattcagatacgacatcatctttccagcccattcttgaaagacccgcagcagctaaaataatagcatcataatcttccgtctcaagcttttgaagtctcgtatctatgttgcctctgatccatttaatagtaagatcagggcgctcagcaagaatctgggcgcttcttcttaaactgctcgtgccgatgatgccgccttcttttatgtcgtccagcttttgatgccccttggaaatcagcgcatcacgcgggtcctcacgtttcggtatgcagccgatgaccagaccttcaggcaaaacagcaggcatgtctttcatgctgtggaccgccatatcaatctcctgatgtaacagcgcctgttcaatctctttgacaaacagacctttgccgcccacttttgacagtgtgacatcaaggatgcggtcgccttttgtgacaatctcctgaatttcaaagttatacgaaggattcaattcctttagtttgttaatcacccattttgtctgggtcatagccagtttgctccgtctggaacctaccttaatcgttctcattttctttcctcccgaatctgtttggcgcgtgacgttaactgaaccaatggaattgcgataggcttccgagcaggaagtaattaatcatcagcacgagaaaacatgctgaattccataacgccgccacttttccctgcagttccttaatcattctgatatataaatagtagctgtataaaagcagcacaataaacgagccgagcacttttgaatcaaaccagtacagcgtttccagagacacatacgcccagattacgcctaagatcaaacttaacagcagcatcggaactccgatgacattcaaaacgtaagccatataatcaagttttgacaaatcttcaattctcaacagccattttccccattttttcttctttaataaagaatattgaaattgataaagaagcgaaaagacaaaagaaagggaaaaggcgccgtatgagagaatcgccattgtgatatgaatgaccaaaagctctgagaccagctggccggaaaaagctgccgaatgctgatcagtcggtgaaaacgtgtggatcgcgatcatcgagaaaccgatgacattcgtgaaaaacacgataaaatcaacccgcagaatctgcgtgacaacaagtgagagcgtaacaagcacccacgcataaaagtaaagggcctctgtaatatttaagaccggaaatctccccgtctgccacataaaataagaaagatagacggtttgcagagtccagacaatagaaagcaaccagaaggccattttcccagccttccggttgtgttgaagaaaatctataaagtaaaaaaggacgcttactgcataaataacaattgtcgcttcattaagtcttgccattgctgtatcaatcatacagcgctcactcacttacaagcggacgtaagcccgtttttgcttctgccttttgaaacgaatgaaccgtctggcggttatccaggcttttgtccagctggcggccggcttcatcctcaatatcgaaaatctgcataaacagcttcagcttttcctcggaatccgcttcagccgcaagctctttcgctttcagaatcgggtcgcgcagcatctggttaatgatgcttttcgtatgtttgctgagcagttttttctctcttaccgtcagattaggcagcttgcgctcaatgctctgcatcgtatcggactggatggacagcgccttttcacgcagcgccgaaatgaccggcacgacgccgagcgtattaagccactgcttaaattcaacaattgccgcttcaatgaacagctcgactttttcagcggtttcacggcgttcttttaagttggcttcaacgattccttcaaggtcatcaatatcgtacaggaaaacaccttcaagatcgttcagcgcaggatcaaggtctctcggcacagcgatgtccaccataaataacgggcggcccttccgctgtctgcccgctctctccatcatatctttagacacgacaaaatcactcgcgcctgtcgagctgattaaaatatcagcttcagcaagtgcatgttcaagctggtttaagctgcgagcttctccggagaaacggtcagcaagctcttttgccttcaaaaacgttctgttgatgaccgttactttgccgatgccctgtccgtgcaggttttctgcggcgagctcgcccattttccccgcaccgagaatcaaaatgtgcttatttgacagagagccgaagatttttttcgcgagttcaacggccgcgtaactgacggaaacggcattggcgccgatatcggtttcagcatgcgtgcgtttgccgacagtcaccgcctgtttaaagagctcattgaaaatggtgccgattgtcttttctgtctgcgccgttttaaagctcgaacggacctggccgagtatttgtgtttctccgatgaccatggaatccaaaccgcacgccacacggaataaatgctcgatcgccgcatcgctctcataaaatttcagaaacggagacagctcttctttcggcagcgagaaccattcggataaaaatgtctttatataataacggccggtatgaagctggtcgaccaccgcatatatttcagttcggttgcaggttgacacgataatgttttcaagaacacttttttcttcttttaaacggagcatcgcttctgcaagctcatccggctgaaaacttattttttcacgtatttcaatgggggcggatttataatctactcccactacaagaatatgcatagccgttcatgcacccccgtacatcgcaatttatttataatcattctaacatagaatttattatttataataattataacatagtttcttcgtgaaaatgtgaacagatttcaaaaatgttatgctatagtataaaaagcttcgtttcctctgtaatcatcatactaaaaatcctttactgcgggtaggtgacaggatgaaaaaaacatcaattttattaccaggacttctgcttgccgcttcattattcgcatggcttcagagcggacaggtccgcctctttgcgaatcagggagaatggccggtgctccttatgcttttgggtgccgtgttcttgtatcagggcaaaaaggaagcggctgggcctcacgtccttatcggtatgcttctgttcggaataggtttacactttttcgccaaaccagagctctcttggtggccgggagatttcgaaatgctgctcttcgtactcggtttctccttatttgcggccgccagaaaagaatatgtatacgaagcggttgccatgattggtttttccctctttttatacttctttaaacaaattacggcgtggatggaatccgtgaatattccgacggagcatttcaaaacatactggccgtatgttttcgtcggaatcagccttttcttattgtttatcaagcggaacaaaactatacgataaaacccaaaacgcactgcgttttgggtttttcattacctgctgatcatttttttaatggctccccatgcttcatcttttcctttttttgtttcagaggagaataaaatcagctcatcttcagggtccatatcaagcgtctgtttgacaacctttaagtgcttgtcccattttccttttggaatcttatccgcttttgtcgcaatgacgataacgggaatgccgtaatatttcaagaattcatacatgttcacgtcatcagcagacggcgcgtgtctgaggtcgacaatctgcacgcaggctttcagctcttcacgggtcgtcatataggtttcaatcattctcccccatgcttcccgctcgctttttgaaactttcgcaaacccgtacccgggaacgtcgacaaaatgcaattcatcattgatgatgtaaaagtttaaggtctgtgttttccccggttttgatgacgttctggccaggtttttccgattgattaatgaattgataaaagatgactttcctacatttgatcttcccgccagcgcgatttccggaagtcccccatcagggtactgttccggtttaaccgcgctgatcacgatttctgactttgtaactttcatttcttctctcctactaaggcatgttccaaaacgtcatccagatgtgacacgaatataaatttcagtccttctctgacgctttcaggaatatcctctatatctttttcgttatctttaggcgcaataatcgtggtcaggcccgctctgtgggcaccgagcgccttttctttcagtccgccgatcggaagcacgcggccccgcagcgtgatttctcccgtcataccgacttcgcgttttaccggacgatccgttaacgctgaaacgagcgccgtggccatcgtaattcccgcagaagggccgtctttcggcaccgctccttcagggacatgaatatgaatgtcatggttctcatggaatgtcggatcgattccgagctgttccgcttttgagcggacataactgaaagctgcctgggcggattcccgcatgacatctcccagcttcccggtcagaatcagctttccttttcccggtgacaatgacacctcgattgaaagcgtgtctccgccgactgtcgtatacgcaagccccgtgacgaccccgatttgatcttcggtttccgcttgtccgtatctgaatatccgttttccaaggtagtctgccaaatttttctctgtaacggtaatgcgttttctttcctcagaaacgatggcttttgcagcttttcggcaaatggcggcaacctggcgttcaagcgttctcacaccggcttcccttgtataatagcggatgatgtcggtaatcgcctgatcccgaatctgcaggttgctctttgtgagcccgtgctctttgatctgtttcggaagcaggtggtcttttacgatctccagcttttcgttttcagtatagcctgacaggctgataatctccattctgtctctgagagggcccggtattgaagcaaggttattcgcagtcgcgataaaaagcactttcgataaatcgaacgtctcttcaatataatggtcgctgaatgtgctgttttgttccggatccagcacctcaagcatcgccgaagacgggtcgcctctgaaatcagacgacattttatcaatctcatcaaggagaaagaccggattttgtttgccggcttttttcatcccctgtataatacggcccggcatcgctccgacgtatgtacgccgatgcccgcggatttcagattcatcccgcacaccgcccagtgaaattctcacaaaacggcgccccatgctcgtactgattgattttgcaagagatgtttttccgactcccggaggtccggccagacaaagaatcggccctttcagcgttttcgtcagctgtttcacagccaaatactccagaatccgttctttcactttctctaaaccgtgatgctctttgtctaagatttccccggcttttttaatatccagtttatcttctgtttcgtccgaccacggcagagcgataagccagtcaatatagttgcggataacagagctttccgctgagcttgacggcactttttcgtaacggcttaattccttaagcgccgtttctttgacacgctcaggcatgccggcttcttctatcttctccgtgagcgactgaacttcaccggttttcccttctttgtcgccaagctccttctgaatggctttcatctgttcacgcaagtagtattccttttgagtgcgttccatcgaacgcttgacgcgctgtccgatttttttctcaatttccagcacttctttttcattatgaatagaacggatgaccttattcaggcgttctttaatatcagccgtttctaaaatatcctgcttgtcctttaatttcagcgggagatgagaagcgacgatatccgccattctgccgggctcttcaatatcagtcacggctgcatacgtttctgcggagatttttttagaaatttttatgtactggtcaaaatggtccagcagcgtccgcataagcgcttcatcttccacgtctttcgaatcgtcctcatgcatcagctgtatatcgaccgaagtataatcttcgagctcggtgtattcaaggatctgcgcccgctgaattccttctacaagcactctgatcgtaccgttgggaagcttcagcatctgtttaatttttgtataagtgccgacggtgaaaatgtcctcttcacccggttcgtctatcgaaatatcctgctgagtggctaaaaaaatcatatgatcatgcatcattgcctgttcaagagcctgaaccgacttgtcccggcctacatctaaatgtaaaaccatcgtcgggtataccaataaacctcttaaagggaggagcgggatgctgcgttttgtatcttctgccatgtgactgacacctccgtgactttagtatgaaccattataatacaactttttcatcgttgtacaattccgggatcgggcaatcatcggcttaccgcctgccctgtatataaaacagtctcttcgtagtataccctttctttctgttctgaaaaaggaaaagatgtcctccataaaaaaaccccattataaaaatggggtttatacggattccttattcatttggatatcaaacggtttctgttctgaaggcgggtctaccaatatgacgtcaagcacttcctgaaacgtttttaccgctttaatggtgattccatctattcgtttcagaatggactgctgattttcataagggataatgaccgtttttgctccggcctgctttgcggctttgattttcgggataacgccgccgatgggtttgacaagccctgtcaggctgatctctcccgtcatcgccaccgtatggtcgatagggatgcggtgaatcgcggaaaaaatccccgcagccatcgcgatacccgcagaaggtccgtcaatcggacctccgcccggaaaattgacatgaatgtcatagtctgaaggtttgatgcccattgtgcgaagaaccgtcagaacattctccactgaccccttcgccatacttttgcggcggatcgactttgattggctgccaatgctctcttcctctgcgattcccgtaatattcaggctgcctttgtcctgcgcaggcgtgacattcacttcgatttccagcaatgcgccgctgttcggcccgtaaacggcaagcccgttcacgataccgacttgcggttcatcagcgattttctgctcatttttcggcgtaagctgactggaatgaacaacccactctatatcctctgtcgtaatttctttcctgtcctcggtcaccgccataccggcggcaatctgaatcatattgacggcttcgcgtccgtttctcgtatatgcggtcagcacaccaagagcctcatcagaaatctctttctgaattttgtcggccgcttttttcgcaacggttttaagttcatccttttccagctcgcggaaaaacacttcaagacagcgggaccggatggccggcggaatttcattcggcattctcgttgtcgctccgatcagtcggaaatccgcgggaagcccgttttgaaaaatatcatgaatatgattcggtatctgcgtattttcctcactgtaatacgcactgtctaaaaatactttccgatcttcaagcaccttcagcattttattcatctgaatcgggtgaagctcgccgatttcatcaataaacaatacaccgccgtgcgcatgggtcacagccccctgcttcggctgcggaatgcccgcctgacccattgcccccgctccctgataaatcggatcatgcactgaaccgataagcggatcggcaataccccgttcatcaaatcgtgcggtcgtcgcatcaagctcaacaaaaacggcctgcttctgaaatggtgactgtttatgttttttcgcttcttccaatacgagacgcgccgcagccgttttaccgactcccggaggcccgtaaattatgacatgctgcgggttcggaccgcaaagcgctgcttttaatgctttaatcccatcctcctggccgacaatatcctgaaagcttttcggccgcaccttctctgataaaggttctgataaactgatggcgcgcattttgcgaagctgttccatttccttttttgattctttatctatcgtcactttttgtgtacgctggtttttgagcagattccaaaaatataatccgatgactatcccgaaaaacagctgtacaaataatgcgatccctgtccaactcatgctggtccctcctgaaaaaacgatttatgtatccaattcattcctctgtccgctagtatctcccagcaaagcccggaataaacatttttcagaagggtcgggacaagaaaaaaacctcctgatcaatccgagtcaggaggttttgtaacgttacgctgatgttttatcttgaccgacaacagtgccgtcttttaatacaagacgcggtgcttcaccgtctgccactgtcgctccggtaatgacacatttttcaatgtcatcgcgggacggcagatcaaacatgacgtcaagcatgatgccctcaatgatagaacgcaggccgcgtgcgcctgtttttcgctcgatcgcttttttcgcaatttcagataatgcctcgtcttcaaaatcaagctcgacatcatctagttctaacattttcttgtattgtttgacgagtgcgtttttaggtttagtcagaatttcaaccagtgccgtttcgtcaagctgctcaaggcttgcaatgacaggaagacggccgatgaattcaggaatcagcccgaaacgaagcaagtcttccggaagaactttagaaagcagttcttctttttccaagtctgccactttattatcagagccgaagccgatgactttttgtccgagacggcgtttaatgatttgttcgatgccgtcaaatgcacccccgcaaatgaacagaatgttcgtcgtatcgatctgaatgaattcctgatgaggatgtttgcgccctccttgaggcggcacgcttgcaaccgttccttcaagaattttcagcagcgcctgctgaacgccttcgcctgatacgtcacgtgtgatggacgggttttcagatttacgcgctactttatcgatttcatcgatataaataatgcctttttccgctttttccacatcatagtctgctgcctgaatcagtttgaggagaatgttttctacgtcctcaccgacatatccggcttcagtcagagatgtagcgtccgcgatcgcaaacggcacgttcagaatacgcgcaagtgtctgggcgagaagtgttttcccgcttccagtcggcccgattaatgaaatattacttttagaaagctcgacatcatccactttactgttggagttgatgcgtttgtaatggttgtataccgcaaccgcaagtgatttcttcgcctgatcctgtccgatgacatattcattcagaatctcacggatttcctgcggcttcggaacgtctttaaattcgacttcttcttctgtgcccagctcttcttctacgatttctgtacagagctcgatgcattcgtcgcatatatatacacccggtcctgcaaccagcttacgaacctgatcttgcgtttttccgcagaacgagcattttaattgtcctttttcctcgttgaatttaaacattctttcaccccttaatcttgtctcactttttcttttacctgaagggcaaaagaaaacggttcttgctacgatcgagtatgtattgcattttaccatactttccagtaagacggtaacaatgtgtttcgcgcttgcacattctatatgtatgacaaaaaacagcccggcaatgactatcttgccccaagaaaaagagttatatcataattgtacaaaacaaggcacgaattaatcgcgccctgttttattatgtctattattatgaaccatattaacggttttctacaagaaaatcaattgcttttcgaacttttaaatcttctttcatcgcgtcagttgaaccgattgcctgcttgatgttttcaaccggcatgttgtaagcttcagccattttagtcagctcagcttcaacttcttcgtcagtcacttcaagattttcagcttgagcgatcgcttcaagcgtcaggtttgattttacgcgttttgcagcatcttctgtcatttgctcttttaacgcgttttcatcttgacctgagaattgagtgtaaagctcaaggttcatgccttgcatttgcagacgctgttcgaattctttcagcatgcggtcaagctcagtgtcgatcatcgcttgaggaacatcagcttcagcgttttcagatgctttcagaacaagctcttcacgcaatttagcgtcagcttcgttttcttttgcttcttcaaggcgtttttttgttttctcagttaattcagcaagcgtttcaacttcttcgtcaatgtcttttgcgaattcgtcgttaagctccggaagctctttcgctttgatttcatgaattttcactttgaaaacagctggttttccggcaagctcttcagcatggtactcttcagggaatgttacttcaacatccttttcagcgcctgcttcaagacctgttaactgctcttcgaagcccgggatgaatgaacctgatcctacttcaagtgagtagttctcagcttttccgccttcaaatgcttctccgtcaacgaaaccttcgaagtcaagaacgactgtatcgccgttttcaacagcgccttcttctttcacgacaagctcagcctgacgctcctgaagcgctttaagttcgttttgtacgtcttcgtcagtaacggacacgtcatctttttcgatacctaagcctttgtagtcaccgagtttcacttccggttttacagtcacttttgcagtgaaaattaagctttcgcctttttcgattttttcaacatcgatttcagggcggtctacaggctcaatgccggcttcttcaaccgctttagggtattctacaggaagtaaaatatctaaagcatcctggtaaagagcttcaacgccgaaacgctgttcgaataaaccgcggggaactttccctttgcggaatccaggaatagaaacctgttttactacttttttaaatgcatcatcaagagctgttttaaacgtttccgcatcaacttcaaccgttaatacgccttcgttgccttcttgtttttcccattttacagacatgtgtttccctccaaaaatctattcaggttgtgtcggtcttccattctaaagcaatccgcggctttgtcaaagaaaaaaccgctttgaatcagaatcattatgtaatgaactggcagcctgtccaaccgtaattctcatttcagttaaaccgctatacataaatacaaccactatattataacataacgcctagcgctttcaactatatggcgtgatttacaaataagaaatttcttcaatatccttaatcatcgtgcaggcttcttcgagttcacggctgtcaaactcgtacatcatatgaagttcctccggctcaatgtcaatgccgtgcatctcgtaaccgaccttatgaagcgccgcggcccataaatctgcgttcaaaaacttcggcataaaagggtgcaatacggtcagatgccttctccacagctcctcaacggcggcgtataatgtaggattttcattgccgagcgtttcatcaagcacccggagaacacgatgcaaaatcggggccgcatcaggctgaatcgtttcactcgggatcgcggtcattgaatcaccgaattttgtaatatggaccggtttgctgtagtcgtgctccgacataagcgtcaaaatcatcgttttgatcagcggatgcgcgcccggatcttgaagaatcgtttttaaaaggcccgtgtatttcgcaatattgcggtctttgagagaatgaatcagattcatttgttctgcggggctgttcagcactttttccgcatcaagaacgtcttcatattcctcctcccacgcctcatcctgctgatcgggatcggtcattttgcggctgaattcgagcagccggtagaattgttccgcactttctgctggcagctggttttcctccagtacagcttcaattgtgcttttgacttcttcatattgtttcagctgaattaaaatggtcatatacacctgcagcacggtaaaataatggccgtacccttcattcagcattttctcgcaaacttgttttgcttcttccaattccccgagttccagaaaacaaatcgccatgcctaaatgtacgtcggactcggtatcaccgtggcttaccgcttctgaaaacagttcgagggcctcctgatactgtttatccttcatggcggccatccctttatcaaccaagcgttctttcagacgggggaaaggaatgatatcagcttttttcttgtcatgcgtcatactttatttcctttcaggcgcttattttgttcaagtgtatcaacacgcgtcaggaaacacaagaaaggatgacgcgcacggccaaaaaagccgccggacagatgccggacggcttttttcaggctcgaagccaagaacttcttttcgattcaaactgctgaatgtcgtcctccagcagaagcgttaatgaaatttcatcatagccgttaatcagcatttccttccagtgaggatcgacttcaaacgaaatctctcttccttcgctgtcgtgaatgagctggttttccaagtcaaccgtcatattaagggactgattttcatattgacaggcgagttttttccactgatcatacggcatacggatgggaagcataccgtttttaaagcagttttgatgaaaaatatcggcaaatgacggggcgatgatgattttgaatccgtaatcatccagcgcccaaggagcgtgctcacgggatgatccgcagccgaaattctctccggcaattaatatagacgcgccttcatagacttggcggtttaattcaaactcaggatcaggctcaccgttctcaaggtatctccaatcaaaaaacgcgaatctgccgtatccggttctttcaattcttttcagaaactgcttcggaataatctggtccgtgtcgacgttgatccggtttaagacggccgcttttcctgtatgcgtttttaaaggttccatctttcgcgcactccttacacaactgttttttcttgataaaactttcttacatcgacgaaatgcccgtgaatggccgccattgccgccatggcaggactgacaaggtgtgttctcgcgccttttccctgtctgccttcgaagttgcggttggatgtggaggcgcatcgttccccttcaggcacgacatcattgttcatactgaggcacatgctgcagcctgattctctccattcaaagcccgcttcaagaaacacacggtgcagcccttctttctcagcctgctgtttcacgctttgagagcccggcaccacaatcgctctgacgctgtcggcgacttttcggcctttaatcatatcagcagcctggcgaaggtcggtcatccgcgaatttgtacaggagccgataaatacatgttcgacttttatatcttcaattttttgattcggttcaatccccatgtattcgtacgcgcggatggcttcttttttaccgtcgtcagaatcaatgctttccggcgccggtatttgagcatctaccggaagaaccatgccggggttgatgccccatgtgaccattggagaaatctcgctgccgtctaacacgatggaacgatcgtagacggcgcccggatcggtttttaacgctttccattctgcagccgctttttcaaactcttcgccttttggcgcgtatttacggtttctgcagtattcgatcgtcgtttcatcaggagcgatcagtcccgcgcgcgctcccgcttctattgacatattgcagacggtcatgcgttcgtccatagacatgtttctgaatacttccccggtgtattcaatgacatatcccgtaccgaatttcaccccgtattttccgataaccgataagatgacatccttcgcggtcactcctttttggagcgttccgtcaacgcggatttcaagcgttttcggccgctgctgccataatgtctgtgtggaaagaacatgttccacctcacttgtgccgataccgaaggcaagcgccccgaatgcgccgtgagtcgatgtatggctgtctccgcaaacgatcgttttccccggaagtgtcagaccaagctcaggcccgaccacgtgaacgattccctgatccgcgctgtgaagatccgcaagacggacgccgaactcctcacaatttcgttcaagcgcggttacttggcgctttgcgacttcatcttttatgtcaaaacggttgacagtcgggatattgtggtccatcgtcgcgaatgtgttctgcggccgtctgacctttcttcccttttgccttaatccttcaaacgcctgaggagacgtcacctcatgaattaagtgcagatcaatatagagaagatcgggttttccttcaccgctttttacaacatgccgatcccaaatcttttcgatgattgttcgaggcatcatctttgtttcctccctctacctatgaactaagaccgctctcttttaagcgtcacactatagattttgtattcgcgccgactaatgcggcttttactttttcagtaatatcatgcgttccggcatattggccgccccgggcgatatcacgtgtgcggctgccgtctgcaagcacctttgcgaccgctttttctatggcttgcgcttctgtttcaagtccgaaagatgttctcaagagcatcgccgctgataaaatcgccgcaaacggattggccatccctttacctgcaatgtcaggcgccgatccatgcacgggttcaaacaagtgaagacctgaacttgataaactggctgacggcagcatgccgagcgagcctgtcagcatagaggcttcatcgcttaaaatatcgccgaacatattttcagttacgatgacgtcaaattgattcggagcgtaaatgagctgcatcgcggcattatcgacaagcatatgctcaagcgtcacatcaggaaattcttttgcgatttcatctgctgtttcacgccacagcctgcttgaagaaagcacattcgccttatcaactgacgtcactttccctttcctgccggcagccatcttaaaggcttctctgacaacgcgttcgatttcttctttcttataaaaaagggtatcgaccgcttctttttctcccgcttcattgacatactgtctgcttggctctccgaagtagaggccgcccgtcagttcccggacgatcacaaagtcgaccccgctgatatattcttttttcaacggagatgcctcagacaggctttcaaatacggtcacgggacgcagattggcaaacaggccgagtttttttctgatgccgagcaagcctttttccggcctgagctcaggagaattttggtcccatttcggtccgccgactgcaccgagcaaaatggcgtcggatctttcacaaagagcaacagtctcctcagggaggggattttgatgagcgtcaatggctgctcccccgatcagcccgttttcaaattcaaattcatgtccgaattgttcggcaacgcttttcagtacatctgccgctgattccgccacttccggcccgattccgtcaccgggaagcaaagcaatgcgttttttcaaatcaaacgttctcctttctattacgagccgaccgcagtctgtctctttaatccgtctatattgcaatccagcaccaattgccggttcactgcattcagataagcttttgcagaagcttccagaacatcatgcgcgattccccgccctgatgattcttttccgttcacggtgactctgacataaacttgagccagcgcgtcttcgcctttccggttggactggatgcggtaatccaacagttcaatatttttatcgatgcagcgcccgagcgtgttataaacggcttctacgctgcccgctcctgttgccgcctcttgaattagctgttcgttttcctgatttcgcaaagagactgttgcagtcggcacctgagacgtcccgtaatgcacttgcagagacaaaaattcatagccgatttttttgtccgtcactttttcttctaaaataagagaaatcaggtcatcatcggtgatttctttcttcttttcagtcagttctttaaacatcgtaaaaaatttattgatttcatcactgtcaaactggaatccaagcgcattcaggcggtctttgaacgcgtggcgtccggaatgctttccgagcacgagcgcctcagcagtcacacctacaagttccggtgaaatgatttcatatgttgatttctctttcaggaaaccgtcttggtgaatacctgactcatgtgcgaaagcattatctccgacgatcgctttattgcggggaacggccattcccgtcagtttgctgacaagatcactcgtccgctttaactcatgaagggtgagagatgaatcagcctgatacgcgtcatttctgacatgaagcgcaacggcgatttcctcaagcgcggcgttaccggctctttctcctattccgttaatggcgcattcaatttgatcagccccgttttcaattgccgaaagtgagttggcaaccgccattccgaggtcatcgtggcaatgggctgagagttttgcccggctgatattcggaacgtgttccttcatatatttaaagatatttccgtattcagcaggcgtcaggtaacctacagtgtccgggaggttgatgacgctcgcgccggcatcaatcactttttctacgatttcagacagaaacggaagttcagttcggcatgcatcttccgctgaccattgaacgagcggaaagcgttcttttgcatacttcaccatttcaaccgctttttccttaacctcttcccgcgtcattttcagcttatgcttcagatgaatgtcagaggtggcgataaagacgtgaatccgcgggctgactccgtctttcagcgcttcccaggctgcatcgatgtcacctttgacagagcgggcaagccctgttaccgaacaatttttaatcgttcttgcgatttcctgcacggctaaaaaatcacctcgggatgaagcgggaaatcccgcttcaataatgtccaccccgagtctctcaagctgcttggctatcgccagtttctcccgtgcattaaggttgactccgggagattgttcaccgtcacgaagagtcgtgtcgaagacattaattttgcgcaacggagaccaccgcttccttctttttgccttgtttgacaaacggcatcatttcacgaagctgtctgccgactttttcaatctgatgctcgttttcacttgcattgatcgcattgaaacgaggacggttcacttggttttccacgatccattcttttgcgaatgtaccgttttgaatatcagttaatacttgtttcatagattcttttaccttcgcgtcgactacgcgcggtcctgatacaaaatctccccattgagccgtatcggagattgagtatctcatgcctgccaatccttcttcatacattaagtctacgatcagcttcagttcatgcagacactcaaaatatgcaagttcaggctggtatccggcttctgtcagcgtttcaaaacctgctttgacaagcgccgttaaacctccgcagagaacagcctgctcaccgaacagatccgtttccgtttcttctttaaatgttgtttcaagaacccccgcacgcgctccgccgattccttttgcataagcaagcgccgtgtctttcgcttcgcctgatacgtcctggtagatggcaaacaatgccggtacgcctgcgccttgttcatatgttcttctgacaaggtgtcccggcccttttggagcgacaaggaatacatcaacatcagcaggaggcacgatctgatggaaatggacgttaaatccgtgtgcgaataccaatgatttgcccgctgtcaattcatctttgatttcagcttcatatactttttgctgctgttcatccggaagcagaaccataatgatatcagcctgggcagccgcttctcttacagaaaatacttgatgaccgtcttcttgggcctgtgtaaatgatttgccttgtctgacgccgacaataacatcaattccgctttcttttaagttcagcgcatgtgcatgaccttgtgaaccgtaaccgataatcgctacttttttacctgccaatacgttctctttgatatcaccgttataatatacttttaccattttaatctctcccttttttgtgttatacaattgaaattgttttattggatgacgccttctgctgggttcccctcgcaaaagccgttgtgcctgttctcgcgatttctttaatgccataaggtttgagaagctctataagcgcttcgattttattggattcgccggtgacctgaacgacgatgctgtctcttgagacatcaacgatggaagccctgaacggttcaataattccgttcatttccgttctggccgacggtgcggaaacaactttaattaatgcaagctcacgctgtacgatcgattggtttgtgatatccgtcactttcaggacgtcaatttgtttgttcagctgctttgtcagctgctctacgtcattttcgccttccacatggacgacaaatgtaatccttgaaacaccgctagtttccgtgtggcctacagtaatgctttcgatattgtagtgtctttttgtaaacagtccggtgatccggtttaatactcccgagcggttgaccaccgttaatgtgataatgcgtttcaaggtttcacccccaccatttcatgaagtcctttaccgggcgcaatcatcgggaatactttttcgcttttggcgacccggacgtcaataacgaccggctcttttgatgaaagcgccttttgcagctcttcttccgcctcttcttccgatgaaatccggacgcctgtaatgccgtaggcttctgacaatttgacaaagtcaggctgcgccgagaatttggattcagaatagcgttcttcatagaagatttcctgccactgtctgaccatgcccagacattcgttgttcaggataatcactttaaccggaagattcagctgccggatgacatctaattcctgcagagtcatctggaaacctccgtctccgaggattgcaacgaccgtggcattacgatcagccagctgcgctccgatagctgccggaaggccgaagcccattgtgccgagacctccagaggtcacccacttatccgcctttcggaaaggataaaactgagccgcccacatctgatgctggccgacatccgtcgccacaatcgcctcaccgtttgtgaattggtgaatatactcaatcagcttttggggtttaaagccctcttctctgttgtctgtataccaaagcggatattcttctttccattctgaaagttgctgtttccattcctccgagtgtccctgttttccgttttgcttcaataattcctgaaggacgattttactgtcgccgaccaccggaatctgcgtttcaataatttttccgatttcggcagggtcaatatcgatatgcgccaccttggcggactttgcaaaatgcttcaggttccccgtcacgcgatcatcgaaccgcgctccgatgctgatcagcaagtcacagtggtaaagcgccatattcgctgtgtatgtgccgtgcatccccgccatccccagaaaaagcggatggtctgccgggaaaccgcccagaccgagaagcgtgtgcgctacgggaatttgctgctgttcagcataattttttaaatcttctgaagctttaccgtgcaaaacacccgctccggctaaaataaccggcttttgcgcactgctgacagcttccacgagctttcggatctgcagatagttaggctcttttaccggctgataccccggaaggctgatctcgtgatcatacctgaattccccttcaaatgatgcgacatccttcggtatatcaattaataccgggcccggtcttcctgttgtggcgatatggaacgcctctttaatcacacggggaagatcttccggacggcgaacctgataactgtgtttcgtaatcggcatcgtaattcctaaaatgtcagcttcctgaaaagcgtcgctgccgatgaccgaagtggccacctgaccggtaaacaccacgagcggcagtgaatcaatcatcgcatccgcaagaccggtaactaagtttgtcgctcccggtccggaagtagcgattacaacccccggcttcccggaaactctcgcatacccttccgccgcatgaatcgcaccttgctcatggcggggcaggatgtgaaccaatcctgattgatacaacttatcgtaaatcggaagaacggctccccccggatagccgaagatcatttcgacattttctttctttaatgattcaatcagcattaaagccccgttcattgtctttgtacaatcggcagacagagtatccgcctgtacatttgtgcccattttcagttcctccttttcaatgttcccttctaaaatccaattcataaaacgaagcgccggctgacgcaaataaaaaagccttcccacccacattcagccaagcattttatgcgatagccaaaaggggcgaaaaggcttgctttccgcggtaccacccttgtttacggtcatatgagaccgtctcatggataattactatccgttttgataacgagtaaacattgacgttcactcggccgagtcctactcttcacatttcagaccggcactctgaggcgagttcactttggtttgtttttgccggctctcagcgttaccggctctctgtgaaaaacttcagcaaagctacttatcctcttctgcgctttttattatggcggctcttttatttaaaaaagaaccttcatttgtttgttttttcagtgttttatgatttttctttttagtgtgaatcatttaattatttttgtttgaactcatattacgctcgtttacaggcagtgtcaacagcatttttataattattagacaatttagattaatcaatctactttgtatacgctttcattactgatacaaaaggatcggtaaatgttaaaagtttttataatttttttgttaatctcttaagattacatgaaatttttccgttcatatacgaatatgtcacattttattccaagatttttcacggtctttccgtcccgcctgtcagatattcagttcagattgaacaggctctttatacagacatacgcatacactattcttatctcgtgaagaaatgagtgatgtcatgaataagatgttatcaggcatgcagggcctgcctcctggatttccgcctttaccggttttaccgccgcagtcttattatcctccggctccgatgcatacagccccatatcaggccggtccttcttttcagcagggatttccgccatccggttacgggcagcagaccccgcaaagcacgctggcattctccggacagcaattcgtcccgtacccttatacatccgggtactacggccaaaccttcagtgacgtcggaggaagcctcggcaccgggacacatcccggcgcactcggaggcggtttcagcggcggccataccggcttcagcgctccaagcggattcagatgatataaaaaaccggccccgcacggccggttttttcttacttacagggtataacggtcattccattgattcaattcctgctccgtatagtaatcagcccttgaaacctcaacaataattaaaccgcattgagtgattaaaaattgtttcagctcctcaaacagctcatcttttccgcaaaagatggtttctatattgtaattcttatatgcaaatgcgtacttcaaaagctaattcctcccgctgtctttctatcgattattgacaaaatgtatgatagaaattagataatttatcactcaagggcgccttaagtatctttatacatatatttattacggtaaatattacattaagtttcatttatattaaaattactttacaattttcataaaatacggaacttttgtttcgtaaaaaaaataaaatacaaaaaaacctcaaacccattgacagggcttgaggtttttaattatacgtcccaggagagattcgaactcccgaccgacggcttagaaggcccatcttgacccagttcatgatgaactgggttttttatatgaaagatctcacagatataaagagctaatgcctttcaaaggcattagcttttttgtttatattgattttgctttgctgctgtgattttgaagactgtttgattttattgtctcgagcattcttaaactgaacacaatcagcagcatcaggagcatcagtgcagtgaacagccagaacgcggtttgtgcgggatactcatccaagctccagccgacggcgatcggaaggagtgaaccccctaatccgtttgaggcaagcagaatactggtagttgtttctgtctttcctgggtaaaaatgattggtgatgattagggctattgcaaacatgccggccatgaacagtcctaaaaagaagcaaagggcaaaaccgaaccatacgcttttacttagtgctaatacagcaagtgcagccaggccgccaacgcttataatacggagataacggtgatatgtcagcttttcagataccggacctgttaataacctgccgataatcatcccagtccaatacacggtgactgttatcgttgctaaggagttggggatatcccatttctcagcgaagatggaggggataaaatgtacaattgaaacttcactgcctccgtaaaagaagaagtaagcagccgccagggcaataaacagcaatccatgtgaccgatagccggtgctttcttttttagtgccgtcggaagagacatctttgcgtatgagaagctgatcaatgctcccaaaactcatttgcttccatgcgattaaaagtgcaaaactggataaccctaatactaaaaaagcaattgtccacatgtggctgttgataagaaagcctgaaagcagaggcatgaacagcgcccctaatccgtaagccacttccatcttgctcatagccacggcttgtctttctttaatagcagtgaggataatcgtgcctacgcaggattccaccaatccagcaccgagtcctgctatactgacgagaagaaagagcagcggccagggcggcaggaaggtgatgaaaacctcacagttgatgagtgccaggccaaagataacgacgtttttgcgcccgaactttttcaccatgtaaggcattccgatgacacccacgaggaagcccatgaactgagaaaatactagtactccgccattgctgtaggtttgtgaataatgtgtgagtaactcagggagtacggctccaagaataacaagtgtaaaggcaatcgatccataagaaaaacagcttatccacagcagacgagttttcatcattttatctccttattggtaaaataatatttctctctactcgtacgacatgatgtttttacaaaaaatccaagtattgttactatatcacataaccttttcacatacatcccttatggtaacgttaacaaattgttaacattttttacaagaagatcgttgacattattttcaattattaatacgataaaaagcgagtttctaataatttcataggggtggtatttgtgggaacgaaggaaatcacgaatccagacagcttgtattacagtgttgacgatgtagtaatggagcgcggagaagggatttacctgtacgatcaagaaggtaatgagtatattgattgtgcttctgccacgtttaacttgaatttaggatacggtaacaaagaagtcattgatacggttaaagatcaagccgataagctgatccatgtgacatcgtcctttcaaacagacgccgtaaataaactagcagaaaaactagtcgaaatcgcccccgataatctcacaaaagtacaccctaaagtcagcagcggttccggtgcgaatgaaggagctattaaaatggctcagtattactccgggaaaaccgacgtcatctccttatttcgaagccacctcggacaaacctatatgacatccgctttgtccggcaactcattcagaaaagaacctttcccgccgcaaatctcttttggcctacaagtacctgatccctattgcagccgctgtttttataatcagaaacctgattcgtgcggtatgctgtgcgtagaaagaattaatgattttattgagtatgcgagcaatggaaaaattgccgccatgattattgaaccgatatccggaaacggaggaaacgtcgttccgcctaaagagtattttaaacagctgagaaagctatgtgatgaacatgatatcgccctgatctttgatgaaattcagaccgggttcggacggacgggtaaaatgtttgccgcggaccatttcgatgtgaaacccaatatgatgaccgtagcaaaagggctcgggggcacaggctttcaagttgccgccactctgacggaggagaagtataccggacttccgggatatacacattcctttacgtacggatctaatgtgatggccgctgcagccgcgtgtaaaaccatagatatcatgcagcgtccaggatttttggaaaacgtaacgacggtcggaaattatattatggaccgcttagaaacgatgaaagaggattttgcttttatttctgaagtaagaggcgtcggtctgatgatcggtgttgagattgtcaaagagaacaatgaacctgatgtggagctgaccaattatattgccaaacgggcgatggattacggactgattctccggacatcccgttacggattcggaaatgtatttaaaatccgtccgcctttaaccattacacttagtgaagctgaggtgctctgctacagacttcgcaagctattggaggaaatcaagtgagagactatatcattgagcttggacaatatgtttatcaaaaggtgaaaaatcaaaaaggcacgctgaaaaatcggctcgtaaacggatattcccccggaggcgatgctcaatttaatatagacgccgctgctgaggaggcggtgctggattatattcaagaaaagggccatccggttgctttttacacggaggatggcggcctcaagctgattggagagaatccgcaatatattttaattgtagatccgatagacggaacgcgcccggccgccgcgggacttgaaatgtcatgtatttcgattgcgcttgcttcctataagccaaacgcaagaattaaggatatcgaatttgcttttttacttgaattgaaatcaggcgcttatatgtacggtgatatttacagcgataccattcaatttgaagggtatcagggagaattgccgaatttgagcggagtgcaggatattaaaaatatgttttggagccttgagtttaacgggcatccggcgcagctgatgacggacgcatacggccatttgattgaccagtcggccaataacggcggagtctttgttttcaacagcgcttcttattcgatttcacgaattattacggggcagatggatgcttatgtggatatcggcaatcgtctgctgaaagatgatccgaagctgctttcagattttcagcaggtcgggaacggacaggtgctgcacttatttccttatgatattgccgcgagcgtctttttggcgaagaaagcgggagtggtcattacggatgcgtacggccggtctttagacgacacacttctgacagatttaagttaccagaatcagcaatcatgtatcgctgcatcaacgaaggagcttcatcagacattattagaccaaatccgctggggcagaaaggaagagagatatgaaggcgttggtctggactcctaatgataagcttgaatatcaagaggtggacgagcctcaaattcgaaaagccaatgatgtgaaggtgaaaattttcggcaccggtatctgcggcacggacttaaatgtgctgaaaggaaaaatgaatgcaacccatcatatgattatggggcatgaatcggtgggagcggtcgtggaagtcgggccggacgtgacaaatgtaaaagtcggagaccgcgtcgtgatagatcccacgcagttttgcgggaaatgccattattgccggagagggctgacgtgttattgcgaaaccttcgaggaatggcagcttggaatcggggcgcatgggacgtttgcggaatattacgtgggggaagacaggttcatgtacaaaattccggattccatggaatgggaacgggccacattggttgaacctctctcctgtgtgctgaacgttgtggataaggcttcgattcagccggaggattcggttttggttttgggttcagggccgatcggactgcttgtgcaaatgatggtgaaaaaactggcgcgtttgacggtcgcgactgaaataggcagcttccggagtgaggcggcaagccggatatcggattatgtctaccatcctgaagcattaactgtggatgaagtgaaacggattaatcaaggaagaaaatttgatgtgatttttgatgcgatcggcaatcagctcgattgggcttatcctttcattgaaaagggaggcagaattgtgccgatgggctttgatgatacgtatgagatgacggtaaggccgtaccagctgctgtcaaacggcgtgacgattgtgggcacaggtgaagcccggcagatcatggaggctgcgttggcatgtgcgtccgaccttccgcagctctatgatttcattactgaaaagacggaactgaagaattatgaagaagccattgatcatctcatgggcatcgatccggtgacaaaagagagaaaggatatcagcgcgataaaaaccattcttgtgtctgatccggaacttttataaaaaatggcgaaaacggctcaaatgagggccgtttttctttcttatttatccggtcttgcagatttattaaaaatttaatatgatactctttgttaacaattcctttccccaacgacattatactctgagcgcgtcctcttttgctccgtaagccgtccccatattccccagataaaatcaatgcttccaactgatatggtgcggatttttatagtaaaaaggagtcgttatcatttgaaagattatacattacagcagcaatggttcggaaatgtccgtaaagacattctggccggtattctggttgctctcgctctgatccctgaggcaatcggattttcaattattgcaggtgtcgatcctatggtcggcctttacgcatcattttgcatcgcgattattatttcgatcttcggcggcagaccgggaatgatttcagccgctacaggttcgatggcggtagtcatggtgactttggtggccgattacggactgcagtatttgtttgcggcaaccattttgacaggtattattcaatttattctcggggtcagtaagatagcgagattaatgaaatttattccgcgttcggtcatgatcgggtttgtgaatgctttggcgatcttgattttttccgcgcagctgccgcagttcaaaggggcatcctgggtgatgtatgccatgctcgccggatcgctggctatcatatatcttttgccgaaggttacgacagccgtgccgtctccgctggtagcgattattgtcatgacaattattgcggtggttttccatgcggatgtccgcacagtcggtgatatgggcggaattacaagttcacttccgcatttcttgataccggatgttccgtggacgtttgagacattgcggattattttcccgtattcactggcgcttgcattcgtcggattgcttgagtcattactgacggcccagattattgatgaaatgacggatacggatagtgataagaacaaagaaagccgcggacaaggaatcgctaatattgtgaacggatttttcggaggtatggccggatgcgccatgatcggtcagtccgtcattaatacgaaagccggcggacgcggccggttatcagcttttacggctggagcgtttttgatgtttttaattgccgtattaagcggtatcgttgtgaaaattccgatggctgcgctggtggcggtgatggttatggtgtccatcggcacttttgattggtcatcgattaaaggcttgcggaaagcgccccttacggattcaatcgttatggttattaccgtcttgacggtcgtcctgacaaatgatttatcgaagggtgttttcgtgggtgtgttattaagcgcgatctttttcacggctaaaatttctaagctgaagattgtgtcgcattccgaacagaaagatgtcagaacatataaggtaacgggacagatcttttttgcttctgtatctgagctgatgaatgccatcgattatgatgaagatgtgaaacggattgtcattgatttgacaggcacccacgtgtgggatgattcaggagcggcggctcttgagaaaattgtcgccaaatgtaaagaatacggaattgaggctgaattaaagggattaaatcagaaaagccgagatttaatgaagcaaatggcatagaatttgtgaagtccggatgaatatatccgggctttttttcggttaaatttgccggaatgcattgttataatgaatgagacttgaaaaccgtatataggagacttgcatatgatgtggcttcagaagatgaaccaagtgttggggagaatcatgccgcttttgactccgtcaagtgtggcggcgggtgtgctgttatctcagcatatcagctggatggccggcgctgtgccgtggatttttgcatttattacatttacaggcagtctgagtgccaattttcaatcgctgaagcgaagtattgagcagccgctcccgatgatcatggcattgtttgttctgcatattttcatgcctgtttttgcatggggaagcggtcatttgatattcagcggtgaccctttaactgttacggggctgataatgggtgtggtgattccgaccggaattacgagtttgatttgggccgcgatgtataaggggaatgtcggattgacgctgtctataatcctggttgataccgtactgtctccttttatcgtaccgctgagcctttctgtcctggccggggcaaatgtccagatggatgtgtggggaatgatgaaagggcttttggaaatggtggtgcttccgtctatcgcagggatgatggtcaaccagttttccccgccggtcaggactcagacgataagccggacgctgtcccctttttcaaaactctgtctgatgatagtcattgccattaacagttcggaaatcgcgccgtatgttacgcacttggatatcaaatttgcgggcatcgcggccgtggtattttttattgccatgacgggttatgccgtggcttggctgatcggaaggctcttgaagcggagtcaggatgaaattgtctctctgatttatacgggaggcatgcgcaatatcagtgccggggccgttctcgccgtttcgttttttccgtcgcaagtggcggttccggtcgtcatcgggatgctttttcagcaaatccttgccgctttattcggctatttgctgaggcgctttgaacttaagccggtcgttatgaagtatgaaaaaaaccgctcagccacgtgagcggttttttccgtacagccagcttagagctgaaatgaattgtcttttgaacgcttcttgatggtgtacggcgccctcttcaatcgtgaaagagagctgagattgagagaaacctttttgcctcatgctttcatgcacgtctctattttgtctgaccatagtgttttggatgttgtttttatgctcagcttcacttctgccgacagacatatagatgcgctggcgtgtcggctgcaaaggtgcggagcggacatagtctgccgatttttcataccagaaggacccggagatacagccgattctgccgaatatctcaggcttctgtaacatcgcgtacattgaaaacaatccgcctaatgacgcgccgatcagtcctcttgtttccgggtccggagacatgtgatgcatatcctcaaccgttgggatgatggtatttgtcaggtcttcaagaaagaggctccctttgccgccgaaatcatgaaacgcaggactcagggaaggcgcaggccatggtgtgtactcatcgagtctgttatccggtttgatgccggcgaaaatcaattcaggaagtgttctgttcgcaaattggaattcaattttctccatctgctctaaaaacaaaactcccccatcaagtacgtaaacacagggtaaagccttggtttgaaccgaataggagggaggaagatataccgtgcattcctttccatttatccggtgttctgtgagtgtgcctctcatgcgtccaatccctttttttgcttaaacagcagaaaaaagaaataaggaacgccgagaatcgccagaataatgcccgccggcacctctgatggctgaaagaacaatttgcccgcaaagtcggcggatatgacgagaagcatacccaccagtccgctgaccggtaacgaatatctgtgttcaattccggcaagcctgcgggaaatatgaggcgcgatcagtccgacaaatgccatgctgcccgctgcggtcacacatgcgctgatcagagcgatgcaggcaacgagtaaaatggttttttctttattggatgaaacaccgaggcttttcaccgtgtcctcatcgaaacgtatggtatccagcaatgacgttttcgccatcagcagaggaatgaacacgatcagccacggcagtatcgccgtaatggtcatccagtttgccgaccagatgctgccgttcttccagaccatcgccatctcatagtcctgcgggtccatttttaatgaaagaaatagagacagcgcgctgaatccggaattcatggcgattccgacgagaataattctgccggattccaaatggccccggtgccaggcgaaaatataaatcagcacagccgccatcaatcccccgataaggccgaagacaggcatgcccatggcggatgcaagcgccgtcgcttcagactgcccctgaaacagaagcataaacgcgacgattcccgctccggctccggcattgatgcctaaaataccgggatcggccagcccgttcttggtaatggcctgaataacggttccggctatccccaaaccgagtccgatggcagccgccatgacaatgcgcggcagcctcagctgaaacagcaaaatttcatattgaggattcggatggatgtggaaaagcgtgctgagcagttcacccggctttgcggaaaaagaaccgcttgtcatgctgaaatagcttacgagcaatatgagaacaatcagtatgagataaattccggccattttacgcaccgcgctgatcccctccttttcttttaatcaaataaagaaagaaaggaacaccgatgatagaagtaacaacttcaataggtgtctcaaacggataattgatcaatcggctggcaagatcgcaaagagtcaggaagacgccgccgatgatgcacgcgcagggaatcagcctgctgtagtctgatccgacgagaaagcgtgtgatgtgcggaacgaccaaaccgacaaaggcaatttttccggcaagcgccaccgagcttccggtcaatatgacaacggccgccatcgccatgagtttgatggttcttttctgctgtcccaaactttttgaaatgtcgtctcctaatgatacggctgtgacctttttgctgagaatcatggccgtgatgattccgatagcgaaaaacgggacggccagtttcaaaaaatcagggttcatttgatgcagtctcgcactgtaccaaaaactgagatcctgcgagatttgaaaataaatcgaaagcgcggccgacagactgctgagaagcatactggtcaccgttccgataatggcaagctgcaccggggtaaaaccgccggggagaatggaggccagcccgaaaacaagggcggcgccgaaagcggaaccgataaacgagtatatgatcatttcaatggatgtcgattgagggagcaataccatgcaaagggtaatgataaaagcggagccgtccgacacacccatgatcgaaggcgaggccagatagttccgtgtgattccctgcatgagcgctccggaaacagcaagggcggcgccgataaacatcgcgccggcagcccttgggattcttgaatgccatatgatctgatggtcggtattctccggattaaagtgcagcaatgcggagaacacggtatggacgtcaagctgctttgcgccatataaaacggaaagcagcagcgacagaacaatggcaatcggtgaagcgatgataataatgtgtgtccgccgttttgcatacatgtgaaaaacctactctttattagtcttgagtcaatttatcagccgcaacctgtaagaagcggattttactccaagcggttccgccttgagctaatggatcaatcgtattgacgtatacatggtcttttttgactgccgtcaggctcttccagatcggatttttctctaaatctttcaacgcgtccggtttatccgcgttttcatcatcagagaattgtacgaagatatggtcgggattcatttcgcttaatttttcaagagaaatcagttcctgcgctttcgccgctttgacttcggccggcgccttcagacctaaatcaccgtatagcgtggagttgaaataaacttgttcagggtaaatataaatattgccttgtctgattctgataaccagcgcgtttgactgtttcgctttgctgttgatctttgtttttgtcttttttagatcctgttcgtaatcggcaatgatttctttcgcttttttctctttaccggtaagctgggcgagcagcatcatgttttctttccagtttgatgagatatgagagacagggatggtttcagcggtgccgctcaatttttttaatgttttttccgggaatttggttgatgccagaatgacgtccggctgcagctcaagaattttttccatattcggctgcattttttcaccggttgatacggatttatctgtaatatctttaaacagttccgggaatttgccggagaatgaaatcgctcctgccggatggacgtcgagtaatttggcgtcttccattgactctacgctgcctgtaatggcgattttgtcagtcggcgctttgacttcatatgtttttccgagatattcgattttctttttatctgaagaagcgtcctttcctttacttgctgtatcagatgtttctgagcttccgcaagccgcggccgtgaaagccaaaagcaaaatcatgaaagcgaatgccaatttcttcatctattgttcctcctgttcaattgataactattatcaattggaattatagagaatgaacagagataagaccatggacaatttccggtattaccatggacgatcttcggaaaaaatggaaatgctttgctcaatgatccgctgatggccgcttggagaatattcaatccacgggtcggatgaaatgggaaacacgcgtttattgctgacggctctaaggttctgccatatctcggtctgctgaatgtgctgaaaatagcgaagtgtttcgggttctttgcaagtaaacagcatgatgtagtcagcttggcaatccgccagcatgtccaatgaaatcttttcgtcgggagcaaaggattccggttttgcggaggcaaagcctaaatcgccgaagaagacttcctcaatgctgttgttatgggcgatatacatattttctttgtacacacggacaaataagaaacgctgatgccgcaagtgttgaagcgaatccttcgctgattgcgcaaggctttgataggcttcaagccaatgctttgcttcctgttcttcattcaggtaagcggctgtgcgcagaaactgatctctccaattgtcttgagtcggcaggtagaaaacttcggtgatatcattcaggcgctgtttttcttcttcactgacagaatccagactgaaaatgatgtcaggcgcagcttgagacagcgtatgtaagttctctttccaatctgcgttgtagcggtaagcgctcaggtgaacgggaatgtcggaagagaattgtttgtaataataggccgtccatttcgggtgaagcgccgcagcgtaaggcacgtgatgcagcgggatcagatgccccattatttctttcccgtacgcagccatttttgtgcgtctttttttcatatagcttgtaggtgagctgcctgtatgttttttaaaaatgcggctgaaataaaattcgtcctggtagccgatttgatgagcgatttcccgcagtttgcagctggctttagccatcagtttttttgcattggtcatgcggatgtctgtgatatattctgttacgctctgtccgtatagttttttaaaggtttcactgtaatgcttggggctgatccccgccatttgcgcaagctgggtgagcgtgatttttgtgtcgaattgtgcatgtatgaattgttttgtctgttcgatcgccgctttcgtattgttctgatgacacacttttgcggcatataggtcgtacatcagctgctgaaagtcggctgttgatttcattttctccaatgcgtctgctgattgcacattttcggaaagtgactgaagccggcttgtcaaatgttcaaccgtctgcaaattcatttgctggagtccgtgaaagatgtcttccccattaaccgggagcatcgcttcttcgtctgataaataggaaaaaacacgaagtctgacgatatacaaatggatgccgtctgacggtatagggtcaatattgaatgtctcatcacgaggacagatgtagagtgtttccttctgaagcgggaagctgtctgttccgatatcaatttttccctcgcctttcacatgaaagatcagtacgggggaatcagtgagctgatgctctgacagaaggtcggctgttttttttacggagatgatatcaattggctgaaagaataatgtgtttttcatgagaaaccaccttttaggaaacattcatttaaatgataactgttatcatttgaattgtaccaaataaatgaatgttttcctataaaaaggcggaaatgcaaaacacgtcaaaatgttacacgtgtaacacgaatcttgtcagtatatgaggtattgctttcttacgggcttgaattgatcaagccggcgctgatatgtgctgatgatgtcttgaatggaagcgctttgttctatttttttgcgtacccagccgttgccgatcagcttgtcaaaggctcctgtcggcaggaatgagaagtcgttcggatataagtcatgcatggttttcagaatggagagccctgtttttaccgcttcaaatgtgtttctgtttgttacgtagacttgtacgccgtggcatagcttgccctggtgcttggagaagctggggatgaatgaagcggctctgaaggtgacaccgggaagcttgagactgttaaggcgttcttcaagctctgtgctcttcatataaggcgcaccgataagttcaaacggcttcgtcgtgcctcttccttcagatacatttgtgccttcaattaagcctgttgccgaatatgcgaatatgctgtccggggtcgggatgtttggcgaagggaggacaaacggcagatcggtatcttcaatcgtcatcgtccgtttccagcgcttcatctttacgacggtgaggtcggcgccaatatgaaactctttattgaataagagagcaagctcgccgatggtcatgccgtgcttcagcgggattggataaagtccgacaaatgaagcgtaatcaggttcaagaaccgggccgtccggatttcgtccgccttgcggattcggccggtccaagacatagaaaggaatgcctttttctttggccgcttccatggcataggccattgtataaatgtaggtgtagtatcgcgttccgacatcctgaatatcgaaaatcagcacatccgtatctttcagcatgtcaggtgtcggttttctcgtttctccgtaaaggctgtagacgggaagccctgttttttcgtctatataggatgtgactttgtctccggcctgagcgtccccgcgaacaccgtgctccggtccgaataatgccgtcaaatgaatgtcttgtgcctcgtaaagcacgtcaacgctgcttttcaatgttgagttcacaccggtcggattggtgatcagcccgatcctttttcccttcagttcttgtttataatctttcagcaggcggtcgatgcctgtttcgatgcttggtttcctggcagtgtgtgaatttctgtcagaagccgccgagactgccgtcatggcactgatgacgactaatccggcgagaagcgcagccgtttgtgttttcatgatcagccctcctgtttaaagcggttttccggtttttagattaattccgaagccataagggtacagtgtcgttcctgggtgagtgacggaaggaatgtcaacgggcagcctgcctttcggttttgtctgtccgaatattgcttcaatgcctgccggaatgtttggctgaagaaattgtccatctgcatatcctttaaagccgtagactgcgataagggcttcagcttcttcaaaattagcggcgtcgtaaggattacgaaggctcatcagcacaaagggtttatggttcgattgtgcagatttcatgacggcccgcggaaatgccgtcgtccacttgccgggatctgtgacagaatcgtcaatgttgccgtcgtttacgacagggtcatttttcacgacatatgagcctgtaatgacgtaatcggcgtcggatacgagctttttatcctcatcattaaatgtgcgctcggcgaagttcattttactgatggttaccggccggatctttttcttcttgatgagctgccggatggtttgttccatggatgctgtttgatcttcataaggagcggcaatgagaacgcggctgttctttttcggtttgaatggaagcgtacggtttttgttttgtaagacggtgacggatctttccgcgatttgtttttcagctttcagatggtttttgcttccgacggtttgctttgcttttgcgactttctttttcagacttgtttctttcggtgcgggatatatacctctttttattttcagggaaatgatgcgttccgccgatttgttaatttgctgaagcggaatttcccctttctgaacagccttttttaaagcggaaagaacttgggcaaagcggttttccgtttgcagtgatgtcacttgggccggcatcagggcgatatcgactcctgcttttacggccatgacgaccgcctcttcctggccgaaatgatcggcaatggctttcatatttaatgcatccgtgacaatgacgccgttaaatcccatttcctcacggagaagatgagtcatcacttttttcgagagagtggctggtacgaggatgtctgaaccgtccagcttgcttttataagttgtatcgtcaaaagcgggaaattgcacatgggctgtcatgatcatatcggccccggcctgaatggctttccggaacggataaagttcaatctgacgcagcctttcttgactgtgggtgacaagcgggaggccgtagtggctatcgacatccgtatcgccgtgtcccgggaaatgtttgacggcggcagcgacatcctgtttttgctgagccttcattgaggcaaggccgagtgatgctgtcagatcacggtctgagctgaatgacctgacgccgatgaccggatttccgggattattattgatatcgagaacgggagcgaaattcgtattaatgccaagtgccttcagttctttcccgattatggcgccggtctgagacgcataggctgtttttctcgcggctccgagcgccatattgcctgggaaatgagtgccttcaccaagtcttgttacgatgccgccttcttgatcaatgcttaataaaagcggaatatcaggactcgctttttgaaaggcatctgtcaggcggaccgtttgctcagtgttttttacattttctgcaaatgagataacgccgccgaaccggtacttttgaataagccctgcgacttcgtcattcatttgggtaagagcctcaggggatgactgccccttcttttgccaattgcgaaaatcaggcatgagcatctgccccagtttttcatctaatgtcatgcgggataccgcttgttccgcctgtgacggaatgtccggttttgtcgatgcatgatgtgtgccggaaacaatgaacaacagtaatacagctgagatgacaagtttcataatgatgtcctcctgtcgtcatagtgtagacaaaagacttggggtgtcattcaatggcttcgtaaatcgcctttacaacgctgccgtaacttccggtcgggaaaagatccccttcgaaaacattggggctttcaccggggctgacgacgggggaatgctttttgttggtcaaaagtgcgatccccaggttataagcggggtcaatgatcgtgacggtgccggtccatccggtatggccgtaagcctgcctgcttgcatatgggccgaacatccactccatatcagggctgccgtttttccgccagccgagagcgaaagtcgggtcagatgaagccgccgttgtgaacagatcggccgtttgtttattgaagagagaaacgtgtttgtaggtgccgccgttcagcatgacttgaagaaggacggccatgtcatcagctctggaaaacagtcctgcatggccggacactccacccattgagtaaaaagctttttcgtcgtgaacctccccttgcagcgtatacgtcctgatgtgagggaaatggatggccccgtcacgcgtgttgcctaaacgttcagtggctgcgaatgctttttctttgaagcctttttgcagcggattgaacagggtatgcgttagtttcagcggtttatacagttcttgctccgcataagcatcgagggtttttccggttaggttttcaatgatgcagccgagaagcatgtaaccgatatcactgtatacgtgctttgtccccggtttgtattcaagcgggatttgggtgagaaaacggatcgttttgtcccgttgttgtgaataaaaagggcccgccgtgtcaggctgatagaaataaaaacttgccggcagaccggagtgatgctggagcacatcaatgacgcgtatgcggtctttcccttgaaccggatcgctttttctgtctttgaaatcgggaaggtaagccgagactttttgatatacatcaagcttcccctgactaacgaggcgctgtaatgcaaaattcgccgcgtacatttttgtattggaggctaaatcaaacatagttgatgttttcatttttttcggatgggataaaaggacgtttccgtcatattttttgctgtagccgtatgctttcttttttatcacgcgtccgtcctttacgacgacgaggacggctcccgggaatcctgctacaatgtctttttcaatcatttgatcaacctttctgagctttgctgtatcgtataatttggattgggcgaaggctttgtgctgcggcagaaaagagaagctgatgaccattgtgagtatggcggctgccaatgttttcatattctgattcctcccggctaatcaaattcagcagccatgtcatccgtaaacccgaaagcataagtgaagacaaagcccgccgcgtaagagatgaatagaccgatgatatacaaaacgatctgggccggctgtacgagaaatgagagcggaaggccggagacaccgattgaaaaagtggccacttgaaaatgggcttgaaaggcgccgccgattcccgcgcccaaacacgctgttaaaaacggtctgccgagcgggagtgtgacgccgaagatgagcggctccccgattccgagcagaccggatggaagtccgcctccaatcgctcttttcaatgaggctttttttgttttcataaagatggcgaaggccgcgcctacttgacctgcgcctcccatcgcgagaatcgggagaagcgggtcatctccgattgatcggattaattccaaatgcacgggagtcaagccctgatgcagcccggtgatgacaagaggcaggaaggcggcccctaatataaaccccgacactgctcccccgatattcaatagcgacaataagcctgatgtaatcagatcagaaataaaaccgcctacagggataaagacgacatatgttaccagcccggtgatgagcaaagacaatgtaggcgtaacgataatgtcgatggattggtggacgtactttctgatcaaccgttcggtataagcgataaaaatcgcggcaaaaagcacaccgattaatcctcccctgccagggagcagattctctccgaacagactgatattggcgatctcagggttaaggatcaatatccccgcaagaccgcccatcgcgggtgtcccgccaaattccttcgctgcattgatgccgacaaggacgccgaggtaagcgaataagcctgaaccgataaccgttaatataagcgcgatttgggattctttcgggagccagccggcctgaatggcggctttcgtaatgccggtgattaaacctgatgcaatgagtgcgggaataagaggaatgaagatgcttgatagctttctgagaaacagggtgatgggtgttgtgttttttctgttgagatcagctttttttcgtgaggcggcttcttttaaatcaatgttttttccgggtgacataaggtttgcgaaagcgtcggcgacatgattgacgacacccgcgccgagaatgatctgcagcgtttcggcttcgacgacgcctattactccgtcaagccgtttcagcgcttcaatatccgttttgtcctgatcgaaaggtgtaattcttaagcgtgtcatacagtgggtaaagcctgaaatgttggatgaaccgccgcaattgtccagaatatctttggccagcgcatgataaaatgcctctttgctcatggaaaccctcctctttcagtacaattttcccgcggagctttgcctgaaacgcgtcttaaaagcgcctgcgccgatcatgaaaacggcgcgggctcgtaaagcactttatgatcattgactggggcgttctgaccaagggatgatcagcggtttttttctcttgaaatatgctgttcaatggctttgtcaatgaagccttctgcttctttgagaagtgcttttgcgtgtgtttcgtccgaattcgtcttcagcatgacgatcgccgttttgacatggctgcctgaggcctcaagcgtttcccttgccttgtcgtacgggacgcccgtgatgctttggatgatgccgattgcccgttctttcaatttttcattgctgacatgaacgtccaccattagattttcgtacactttgccgcttttaatcatcacggcggtggaaatcatgttcagaatcattttatgtgccgtcgccgctttcattcgtgttgaccctgtaatcacttcggggccgacgacaacttcgatgctgtgatcggcatacgtgctgatcaatgagtgcttattgcatgtgagggcgacggttttggcgccgattgtttttgcatatttcagcgcaccggccgcatacggagtgcgcccgcttgccgcgatggcgatcacggtatcgtcttcggtaagcccgattgtcttgagatcaagagcgccggtttcctcgctatcttcgattccttcagccgcttgcaaaaaggcgtctgcccctccggccatcagtccgatgacggtgtcgggacttacgctgtatgtaggcgggcattcaaccgcatccagtacaccaagtctgccgcttgtgcccgctcccgcataaatcagcctgccgtttcgccgcaatgactgatgggcaaattgaacggcaatttcaatatcaggcagcacctgctgaacggcgtccgccactttgaaatcctctcggttaatgatgcggaggatttccatcgtgtctgcttgatggattgaagcggtctctggatttcttgtttctgtggtcaatctgtgaatgttaagccggtctgtcatgaatgtaccctcccaagtcgttattacttgaagtatatgggcttctgaatatatgtttcaagaaaaatcggcaggaaagagatgaataatgaaacgctttcacaaaaaatgatgcagaatgtgctgttcgccgatcgggccgatcctgcgccgccctttatcaataaaaccggaagaccggtacaggttctgtgcacgatgattgcgatggttcactgcaagcacgatttcatcacaccaaggaaaataatttgcgacaaaagcggggagctgcagcatcgcttgtttggcataaccttttccctgctgcgccgcatgtaatgacagcgcgctcagcaaaatggcagacacattgttcgaatacggggcgatggtttcttttgaggtatgtaaaataaaaaaaccgactgggctgtcttcttttaaaatgactgtcggataacgatcccggatgacaagcgcctgcggcaggacatctttcgggagagcggagaacattttatcttcttcactgagtacaaacccgttcagcccatctgcatgctccggtttgtaaaaagacagggttacatccatgatatcctctccttttttataattgatccagttcatcttctgataacacacggcagcctgcccgttttaaaagagcggaagtgatgccgtccccgatgatctttttccccgagaaagtgccgtcatagataaagctgcttccgcaggatgggctgttttctttaaggatgaccgtgccggcgcctatttcttttgcgtatgccagtgttttttccgcgccggccatatataaagcggtaacgtcttcaccagatgccgttacgattttcgccgttccgttcagcacatcttcgcccgtgccgccgatgatttccgccggttcgcggggagtggtgaagccgcccaaaagttcggggcagaccataacagctttcttttcatccacgagtctgcggattttttccgaagcggcgtgggagccgttatacctgcattcgataccgccgagacaagagctgactaagatcatctgtgtccattcccttcaatatttatgatacctccatcttaaatgaaataagaaagaagggatgagtttttcagttaaaaaacgggtaaaaaagtttgaaaataaaaaaaataatttttctctttacaaatagggtacaacctgtatataataacttttgtcagctcgacgcggacacaacggcccgttggtcaagcggttaagacaccgccctttcacggcggtaacacgggttcgaatcccgtacgggtcatatggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcactgtttttctgaaaaatacggaggggtagcgaagtggctaaacgcggcggactgtaaatccgctccctcagggttcggcggttcgaatccgtccccctccaccatttttgggctatagccaagcggtaaggcaacggactttgactccgtcatgcgttggttcgaatccagctagcccagtctcagacaccttttacataaggtgtctttttttacggtattttacctcgatttccgattgttcatcagatatactatttttaagctgctgttaaggcagtatattctgtattttccatctacaccctgcctgaaatttggtaaaataaatgtaataaaaaaaatgaaaccttttaaaacaatcaacgtatagatacagaccggtgaagggcagaggtaagataaaacatggaaaacctgattaaaaaaagaattaagcaagtcaaaaaaggcgatcaaaatgcgtttgcggaaatcgttgacctttataaagataagatttaccagctttgctaccgcatgctcggcaatgtccacgaagcggaagatattgcgcaggaggcttttatcagagcgtatgtcaatatcgacagtttcgatatcaacagaaagttttcaacgtggctttacagaattgcgaccaacctgaccattgaccgcatccgcaagaagaagcctgattactatctggatgcagaagtggcgggagcagaagggctgacgatgtattcgcagatcgccgcggacggggttctccctgaagacgccgtattgtcattggagctgtcggacacaattcagaaaaagattttaaagctgcctgacaagtacagaacggttattgtactaaagtatattgacgaactctctttaattgaaatcggggagattctgaatatccctgtcggcaccgtcaagacaaggattcacagaggcagagaggctcttagaaaacaattgagagatctttaagtggggtgatgaaatgagctgtcctgaacagatcgtgcagcttatgcataagcatcttgatggagatatccttcctgaagatgaaaacgtattaaaacaacatttgcggtcatgcgagaattgcaaacggcattttcatgaaatggagaaatccgtagcgctcgtccgaagcacatcgcatgtcacagcccctgctgattttactgccaaagttatggcgaatcttccaaaagagaaaaaacgcgcttctgttaaacgatggatcaaaactcatccgatcattgcagccgcagcggtttttgtgattttaatgggcggcggttttttcaacagctggcataacgaccacaatttcagtgtgtccaagcagccgaaccttgtcgtacagaatcacacggtcaccgtccctgaaggcgagaccgtaaagggcgatgtcacagtaaaaaacggcaagctggtcattaaaggtaaggtcgacggcaatgtgaccgtcgtcaacggagaaaaatacatggcctcagccggacaagtcaccgggcagattgaagaaattaaccaattgtttgactgggtctggtacgaactgaaatcggcgggtcagggcgttgtgagcgctttagacccgaatgaagatgagtaaagcgtataatcgctttactctttttttacggattgccgcgctggctcatttcacttgagaaatcaaaatgtggtataatgagcacgctatatgatgtacatattgctcatgcagcgcaattcataacggaaaaacgaaatgactgaattcttggaggacgaggaaatggcttttgaggacatcccatttttgcaatacctcggcaatgccgttgatattctccttgtttggtatgtgatatataaattaatcatggtcatacgcggaacgaaggcggttcagcttttaaaaggaatcgtcgtcatcgtattggtccggatggccagttcatatttgggactcagcacacttcaatggctgatggaccaagcgataacttggggatttttagcgattatcattatattccagcctgagctgaggcgggcgcttgaacagctcggacggggccggttcttttcaaggagcggcacccccgtggaggaagcgcagcataagacaattgaagcgattacaaaatcgatcagctacatggcgaaacgccgcatcggcgctctcatcgccattgagcgcgacacgggaatgggcgattatattgagacgggcatcccgcttaatgcgcaggtcagctcagagcttttgataaatatcttcattccgaatacgccgctgcacgatggagcggtcattatgaaaaataacgagattgcggctgctgcctgttatctgccgctttctgaaagcccgtttatttcaaaggagctggggacgcggcacagagcggctgtcggcatcagtgaagtgacggacagcttaaccattatcgtatccgaagagacgggcgccatcagtgtggccaaaaacggagaccttcacagagaattgacggaagaagcactgaaagaaatgcttgaagctgagtttaagaaaaacgccagagatacttcttctaaccgctggtactggaggggcaagaaaaatggataaattcttaaacaaccgctgggctgtaaagatcattgcattgctctttgcgctcctgctttatgtggcggttaacaacaaccaggcgccgactccgaaaaagccgggggaatccttttttccgacatcaacgactgacgaggctacgcttactgatattcctgtaaaagcatactatgatgaagcgaattacgtagtcaccggcgtgccccagaccgtgaatgtcacgattaaaggctcgacaagcgcggtgaaaaaggcgagacagacgaagaattttgagatatacgctgatatgaataagctgaagaccgggactcataaggtcgaattgaaggcgaaaaatgtatcggacggactgacgatatccattaacccgtcagtcacgacggttacgattcaggaaaaaacggctgaaagttttccggttgaagttgaatactacaataaaagcaaaatgaaaaaggggtatacgccccagcagccgattatcagcccgaaaaacgtacagattacgggttcaaaaaatgtgattgacaacatttcgcttgtcaaagcatccgtgaaccttgaaaatgcaaatgagaccattgatagggaagtgaaggtgaccgtctatgacaaagacggcaacgcacttcctgttgatgttgaaccgtcagtcattaaagtgacggttcccgtggccagcccgagcaaaaagctccctttcaaaattgaaaggaagggaagtcttcctgacggggtgagcgtggcgagcattgactcgaatccgagtgaggtgacggtttacggcccgcaggatgtgctggattcacttgaatttatcgacggtgtatctcttgatttagacaaaattgataaagatacggatgtcgatgccgacatcccgcttcctaagggtgtcacaaaggtgtcaccggggaaaattacccttcatgttaaggtggacagtgaagacaaaaaggattttagcaatgtcccaatcaagacggtcggactgggaggctcgcagcggattgagtttctcgaccctgaatcgcgggcgatcaatattacggccaaaggctctccgtccaacattaaggcgctgaaaaagtcggacattgagctgtatgccaatgtctcgggcttagatgacggagagcattctgtaaagcttgaagtaaacgggccgcaaaatgtcacatggtccttgtcaaaagacacggttaagatcaggctgacttctaagaaaaacacaagttcaaataaaaatgacggcggctccgctgattccggcaataaagacggcacaagcggaggcgcagacaaagacaagaaccaggaagacactgacagcgatcagaataaaagtcaaaaccaggatcaaaatcaagaccaggatgaagacggatcaagtgctgattcctcttcaacagaatgaaaaaggagcgatacaaaatgggcaagtattttggaacagatggtgtaagaggtgttgccaacagcgagcttacgccagagctggcctttaaagtggggcgttttggcggttatgtcctgaccaaagataaacagcgcccgaaagtgctgatcggccgcgatacacgtatctccggacatatgctggagggagcccttgtcgccggacttttatcgatcggagctgaagtgatgcgcctcggcgttatttctacgccgggggtatcctatttaacgaaagcgatggatgctgaggcgggcgtcatgatttccgcttctcacaatcccgtgcaggataacggcattaaatttttcggaggagacggctttaagctttctgacgagcaggaggccgagattgaacgtctcatggatgaaccggaagacaaactgccgagaccgacaggcgcggacctcgggcttgtgaacgattattttgaaggcgttcaaaagtatctgcaatttttaaagcagacggcggacgaagatttcacgggcattcatgtagcgcttgactgcgcccatggtgcgacatcttccattgcgacacacctttttgccgatcttgatgctgacgtgtctacaatgggaacgtctccgaacggcttaaatattaatgacggcgtcggttctacacacccggaagcgctgagtgctttcgtcaaagaaaaaaatgccgatatcggccttgcgtttgacggagacggcgaccgccttattgccgttgatgaaaaaggaaacatcgtggacggcgatcagatcatgtacatatgcgcgaagtatttgaaatcagaaggccgtctgaaggatgatacagtcgtatcaaccgtgatgagcaaccttggtttctacaaagcacttgaaaaagaagaaatcaaaagcatccaaacggcagtcggtgaccgctatgtcgtagaagcgatgaaaaaagacggctataatgtcggcggcgagcagtcagggcaccttattttccttgattacaacactaccggcgacgggctcttgtcggcgatcatgcttgtgaatacgctgaaggcgtcggggaaaaccctttcagagcttgctggtgaaatgaaaaaattcccgcagcttttagtaaacgtgaaagtgacggataaatataaggtagaagaaaacgctaaggtgaaggccgtcatttctgaagtggaaaaagaaatgaacggagacggccggattttagtgcgcccttcaggcaccgagccgctcgtccgcgtaatggcggaagcgagaacaaaagagctttgtgacgaatatgtcacaaaaatcgtggatgtcgtgcggacagaaatgggagcggaatagcgaagtttataaacagagagcgaacaagacaagtgcgatcagcataaaatgatagtaacatgatgccgggacggaaaaaaataattgaccgtccttggcacatgttgtaaaatcaagcttgttcagcctttgtttttcatttataggaaaggcggcattgtttgcatctttcataattatagcgcccgaactaagcgcccgaaaaacggcttagttgacgaggatggaggttatcgaattttcggcggatgcctcccggctgattcatttagatcacagccgtaaggatttctttaaaccggaggggcgactctccgaacaaagggaaatcacatgatcttccaaaaaaacatgtgggaggggacgattgaaagtccccttgtaatctgactttcttcgtctccttttacacctttaggaggaagaaaaaatgtgtggaattgttggttatatcggtcatcttgatgcgaaagagattttgttaaaaggattagagaagcttgagtaccgcggttatgactctgccggtatcgctgtggcgaatgagcagggcgtgcatgtgtacaaagaaaaaggccgcatcgccgaccttcgtgaagtggtggatcaaacggttgaatctcaagcgggaatcggccatacacgctgggcgactcacggcgaaccaagcttcctgaacgctcacccgcatcaaagcgcacttggccgctttacacttgttcataacggtgtgatcgagaactatgttcagctgaagcgtgaataccttgaaaacgttgaactgaaaagcgacacggacactgaagtagtcgttcagatgattgagcaatttgtagcgggaggactcagtacagaagaagcgttccgcaaaacactgactctgttaaaaggctcttacgcaattgcattatttgacggcgaaaacacagacaccatttacgttgcaaaaaacaaaagccctctgttaatcggccttggagatacttttaacgtcgtggcatctgacgcgatggctatgcttcaagtaacgaatgaatacgttgagcttttggacaaagaaatggtgatcgtgacaaaagacgaagccgtgattaaaaaccttgacggtgaagtcatgacacgtgcgtcttatatcgctgagcttgacgccagtgatattgaaaaaggcacataccctcactacatgttaaaagaaacggatgagcagccgcttgttatgcgcaaaatcatccaaacgtatcaggacgaaaacggcagactggctgtggctggcgatgtcgctgacgccgtggcggaagcggaccgcatttatatcgtggcttgcggaacgagctaccatgccggtcttgtcgggaaacaatatattgaaatgtgggcaaacgtcccggttgaagtgcatgtagcgagtgaattctcttacaacatgccgcttctgtctaagaaaccgctctttattttcctttctcaaagcggagaaacagcggacagccgcgccgtgcttgttcaagtcaaagcgctgggtcacaaagcgctgacaattacaaacgttccgggttccacgctgtcccgtgaagcggattacacattgcttctgcacgcaggccctgagatcgccgttgcatcaacaaaagcgtatacggctcagattgccgtgcttgcgattcttgcgtccgttgcagccgaacgcaatggcgttgatatcggttttgatttagtcaaagaattgggtatcgcggcaaacgccatggaagccctttgcgaccagaaggacgaaatggaaatgatcgcgcgtgagtatctgactgtttcaagaaatgctttcttcatcggccgcggccttgactacttcgtatgtgtcgaaggcgccctgaagctgaaagagatttcttacatccaggcggaaggcttcgccggcggtgagctgaagcacggaacaatcgctctgattgaagaaggaacaccagtctttgcgctggcgacacaagaacacgtcaacctgagcatccgcggaaacgtgaaggaagtcgcagcccgcggcgccaacacttgcatcatctcgctaaaaggtttagaagacgcagacgacagattcgtcctgccggaagtcaaccctgcgcttgctccgctggtatctgttgtaccgttgcagctgattgcttactacgctgcactgcaccgcggctgtgacgttgataaaccgcgcaaccttgcgaagagtgtgactgtggagtaatatatttaacccctttggttattatatttgtagttttataaaaaagattgatcatttataataaagtttgattgaaaataacctcttcggtatgatatccgtaagaggttattttttattattcagataaaaggcggagtgaaaatgttacccaaatataatcccaataatccgagtctattagaatcgatagtttgttttactgatattttaggtttttcaagtttaattataaacacacctaacctacagtctggaaatcacttacttaaagatcttcataaaattcttacaaaacaatatgcgttaatgagagagatgaacccatatggtcattttaaaacatttactgacaatgtcatactagcatatccaagatttgaagatggtgaagggcaatcaggtaatttgtttatgtcatttattgattaccaattagagatgacattaaatgggtatttcttacgtggcggtattgatttaggagattactatggtgatgatgattttgcttatggaccagcgttaattgaagcacatgatttagaaagtagtaaggcaatttatcctagaattattttaagtgatgaaatgattaaaatggtatcgcaacacctgggctattatggttctgcatcatatgctccacagaattcacatttattaatagatgaagatgataaagtttttgttaattatttgtatggactacatgaaatatataacacgactgaagatatcatggaatatattcaaaaaattcaaagtcacaaagatattattttaactaaattgaaccacttcaaaagcgataaaaaactttattctaaatacgagtgggtagctcaatatcataattattactgtgatgagtattttgaaaagaatgcaattcaacaattcaatttgaaaatacctagtatacagacacgtaatttttctagaatagctataagtgatttaatacttatttaaatttaggaagaagctaaagatagaatgtccaagcgaaaacgttcgccctctattggtaagaaatataaagaaggtttcggataaggttaggggctaattataagccgtgggtgacaattcaagatgtaccttcattgggtcacgttacacgtacttctatttgttagaatattacgatttggtaattgatatacgtgaacaatatccactgctatctgttgaagaaacaatcgttattgcagatgagagtttgaaggagttttctggtttgtttatttgagtgatggtgttactgaaaggaagtatgtgattgctgagttcaagctatttccaaataagaagtcagcatgattgaagtagaacgtgaagacagagcatttttcaactttaatatgtttcattaataaccagcagaataaaagctattgttatcctcaaattttaagtggattaattgatagtcatagaactaaagtaataatcagaaaaatttactaagaggtaatgttatgtataaagatatagcaattaattgggatgtgtttcaatataaatttactgagaagactagagatgtatttgaatatttagcttatatacttttttgtcatgagtttaaaatcgaaacaggaatatttagatactttaatcagccatatgtggaaactttacctgtaacaactgaagaaggatgtattggatttcaggcgaaatattacgatgcaggcactagtattgctgataaaaaaacagaattaaaaaatgctattaagggcgcaaaaactaaataccctgaaattgatagatttataatttatacgaataaagaattgagtgcaagtagtaagaaagatactgtaaagcctgaatatcaaacagaaattgaagaatatggacttgagagagatattcttgtggaatggagagtcaaaagtaatttcgagataatgttaatgagacccgaattggaacttattagagattatttttttaatccagattcaggaattaaagggtacttagctcaagttaaacttcatagtcaaagtaaattagagaatataaagtcaactataagatatagagaccaaatcattaaaataaataaaaataatgattttgatatccactctttttatgagtcagaaattccatgtttaattatttatggtgaggggggatcaggtaagtcgggctttgcaaaagatttattagaaaatgaaaatagagctaatatcgcttttaaagcgacagattttgatgttactacttttgcagagttctcaaggagatttggagagtatacttttgaagattatttaaagcttttccaagacgatgaaaataaggtttgtttgattgattccacggaaaaagtattagtgatgaataaccgagatatatttaatgagtttgtgaacttatcgattaagtatggatggaaaattatttttacagtaaggacagtacacaaggataattttattaatacttttttaaatggggtaagatatcaagaattaaagatagagactttgtcaaaacaagaattacaatatttattaaaggattcagattttcctcttccgaaagaagaatcctatattaatctaatttgtaatttgttttatctgaatttatatattgagatagcttgtgaaagcgatagcgatattttaacaattgaacaatttatagaaagtatatggacgtataaaattaaaaatactaatcattatagagagttagatattcgtagagaaaagactatttgtaatattgtcctatcttgtgcgaataagggtgtatattactatgaatatcaactatatgatgattcagaagcaattgcggcactcagggaagatgaaataatattctatgatgaagttatgagaggatattccttgagtcatgatatctacgaagaaattgtattaaaacatatatttgaaaatttatatattaagaaagaagactgtaaaagcttttttgaagagattggtgacagtttagttgtgagaaaaaatcttcgtttatggcttaaagataagttggtacaaaaaactgaaggtattaaagattttattatagaagtattttatacaagtaaaatttcttcaatttggcaagatgagattttgataactttaatgagcattgaagataatcaaatttcaataaactttataaaatccatgttaactagagatgaatacaaattattattcagggcaatattcttattaaatactacgtgtagaattataaataatgacttttggaataaaattttaacttctgaagaacaaaaatctgcaaatctttatagatccacaaagccaactggagcaggatggggttatatttttaatttcatctatgaaaatctaacagcaatagaatggaaacctcaaaatataatgttagttattgaatgtttatatagttggacttcacataatgtaaaaggcattgaaaccaaacatgcaggtttaattgcattatatttatacaataaagtaaaagctgataaatcattaatctataagttaaatgataaaaaaatcgagaaaataaataatgtaatattatcaagtgcctgggaaattgacagtgagttatctatcattgtagaagaggtaacaacagatacagattttaatcatctgcataaatattatgatttgtgtgtgcagggattaactaatgtatacaattgtggaaatttagttgactcgaatcctaaattagtatttgatttagcaaataaatattggttttttaaagacagtatgttttatagtccacgtgaaattgaagatgcttttaaactaaatgactcaacttctcatgattattatccatcaagtgcctttcaaactcctatatttagactattgcagtctagcccttgggagacaatagattttattatagagttattcaataagataaccatagattactccaattcggaattggtcgagaagtatgatgaactcttaacaattaaaattaatctatctaatggaaaagaaatagagcaagtagcgagcgaacgtttatggctgatgcacagaggtacatatccagctcctaatttacttgaaagtatcctgatggcgttagaaagatggttattacttgttttcgaagaaataccaggtgttatagaaaagatttgtataaaactattaagttctcaatcggcagctctaacatcagtagtagtaagtttagtggaggcataccctcaaaagttatttaacatcgcatgcatattaatttcttccaaagaggtttttatattagataacatccgagctgttaaagaatttggttcaaattttttgaagggtgtagttccggctaacaaattgtatgaagacgagagaataaggaccaataatcaagcttttagaaagaaaaggctagaagatgtaattcttgagtatcaattaaatttagaaaaactacctattgaagttttagagaatagaaataaaattttatatagtcaactcgataaagtgtttgagaaaatagagcaatttgaggaagaatatcaattcgtatactatagaatggatatcagaaaattaaagcttgatactgataattttttcgaaaaggatggacacacatatgcctctttggtgacagaactacctgcttctctagttgaaattcataataaaacggaagagaaaaacagaaaaatatttaatagaaatgatttgtatatgtggtcaattgcacgttttgagcataaaagggatagtgaaaagtatatagactatgaaaataatcctttaaaagccttaggggaagctagagaaatttgggagagtgaaaataatgaatatttttatcttcagaagtatgctccgatatatgttttcgctatattaataagggactataaagaattaatttcagaagatgactgtcactactgtaaagatagtattttaaattttattgaattgaacattgaaagtgggaatgttattcaaacaggaagtggttttgaagcggcaatttatattttgccactaataatttctaatgaagatatgagtgacatatctctaaagaaatctattgaattacttttaatattaatactagattctaataaactagtaattcaaactttttcaaccaaaatgtgggaaacaaattttaaaatagcatcaggtattttctgtggttatgttgaattaaaacctctatatgattcagaggttagaatatataatggaatttcatcgattgaatttatcaataaaaatcaacatgtaataaataatattataaaaaatgtctatgctattcctaatgatttttcacatttaagttataattcgttacttaatttaaatatgcttttggcaccaactaatgagattactgtaatgaaatcaatagaaatcggaaaaaatatttgggaaatcttatttgaaaaacgacataaaagaagagaagatgttgtagcaaatatagaaaccgaaatggagtatattaaatggttggcaaaatatttgatgtgtatatcattagaggaacaaaagaaattaataagagcttttgaaccatttataaatagttgtgaaagctttgaatggcttttaagagatattattcttaaacaagatgaaatggataagtatgatgagttttggaatatatggaataatattcaacctattataatatctttatgtaaaaaaacagaagaaagggatagaaccgtttcttcaagagaatatcatgatgatattcatcaaatagttataacttatttatttgcattccactggtggaacgataagataaaatcttggcattcattaaagaaggatgaccatttattttttagatatataagttatgaattaggttataagccaggtgttttgtatgcgattggaagagttttaaatactgttggatataataattatctttcacaagggattgattggttatatgaaataattaacaataatccgcatcttgaacaaaaaaagttagaagtgaatacggaatattatatagaagagtatatgcaacgatatattttagaaaatagattgagtttcaagaaaaaacccgcattacgtaataaagtgatagttgttttgaattttttggtcaatagaggttctacagttagttatatgctaagggaatctattgtgtagtaaaaatagttgaatgctaacttaagattattatctttaaaaataaatataaaatagtaggagtgtatttaatggtgaaatgtaaagaatgtcaaggcgcatgacaaatatgtcctgactttaccggtcagcagaacaaatattgttcaaagtcactatttcttttatcttttggttgttgtgatcggggctgtaatatcttatggtattttctttgtatacagcctgagtgctgaggaacctgttgacggcattttgaatattgtctctttcggaacgttcatcgttctctttgccggtgcaatcgtttatcctcttctctacattatgggcccggaaaagtctgatgcgattgtgattggaggtgcaatgggagggctttttactacctttggattgcaaagtgtcgttggttatgtaacagaaaaattaccactgtcatttttgcacataaatccttctttatatgtccctattatatatatcattatcggcgttatattatatatcatttcttttttcattgccgcagctatctatcgtaaaaaagaatttacaacaggataaggcatggcacgggctcataaatttacttaaattccaagcagaaagccgcccgcacaatgggcggctgttcttctaattaaaactgcgttgtcacatcgtactcataatcaatcttcaattttacatttttcatagtcgatttagctgttgcgagtgtgttgtatttaaaattccagatgcttgccgctgtgaggttatcatccagtgtaataccgtaatttccttgtgtggagctgtttgcaagtgcacggtgccacactttattttcttccgacatgatgtagtggcttgtatttccttggcttggtgtttgggttgcggtggtgttgattcttttcactgtggcgtctcttggaatgcttgtctgtttggttaagtcgagtctaagagcagttgaatctgatccattcggactgaggcttgtatttccattattttcagctgtgccgctgaatgagaaagtctcactgccggatttgattcggtcgtaaatggagagtgtaaagtacatatcgtcagtgtaggagccgcgggacactttcacgtagaacgtctcgttattttctttcgcatctgtattcgcatagataaaaggcagtgccgtatcaggatttatcacttctgtgcctttactgatcagtactttatttttattataaatttcaatgtccattcccttgtattcacttcttgttgaactcctgacataaagtctttctcccttatttgccgtgaaagtgaaatacgaatctttttccccttttggcaatatggcagtatcaatatttttatatttccagtagcctactggattggcagtttcaaatgaatgatttcctgtaatggcgcttatttgtaacgagttcttttgagacgcagaggctgaaggtgaagatgcaaacaatgcgcctgataaaacgatgacactgacaaatagaatcaatatacacttcttcatggaaaaatccccctttttgactacatcatacataaaaacattagctatgtaaacatttgttatttaaggtcaaaatctactggaagacagccgataaaaacactagaacatcatctcaagcggaggttaaaaacatgcgcctaaacgctcgatatataaaaaatcaagtaatggctcagcaagtgcttcagcggtattcttccaaaacaaatgtgaaagatgcggcaaaaggaacggacagcttattgattcaggcaggcgggagccgcgatctgagccaggtgaattattcaaggagcggtgtcactgagaaagggagcagcctgtcccgtttatatcaatccgcaaatcagaaaaccgttacggatactgggaatgagacggtgattcaagccaataatccgtatgagtctgagagtgatattgcgagcaagattcttaatgagaaatacagccgtatcaacgaaatcaataaacgaaagcctgatcctttaggttatattaaggacaaatatcagcgtgccaattcgccttatttcaggagtgatttatcggaatcagagcgtcaggccgcttatcataatgaaacggaatggctgtttaaagggaaagcccaaagctatgattttcgtgatgcggcatttcggggtgaaacgctcagcggagagattgagggagaaaatgaaaaggtgtttcagcgcgggcaggtcaatcagcagattgagatgcttttccatcggaatcatattcagattccggagggcgcgaaccttacatttacgatatcaccgattgattatctgttaaaagtgagcggaacggacgatgaagagctcactaagcagattgaagccgtcttaaactctggggaaaacagcaaagagctgtttgcgcacatcattcggagccggagtgatgattcctcgcagtttacggcagaagcgtatgagaaatatcaagtcgttcgggaaatgtatgaggtgaccggctatcatctgaaagacttgcagattgtgaacggaaagtacgtcacagaagacggccgcgaccttttagacgtctataaagaagcgctgcagcaagatcctttgctgagacatacggccgcagaagcagccgcccattacggacaggggctcacgaagctggcgagaacggggtatgatgccattcctgatttggtgctgtcaattgattatagagacgggtctctgcgtgacgtcggccaacgcaagcaatacggatcaggggatacggactggctttctgaatggaagcggcagctgggcgtgcgtatataaaattaaaaagctgacgaaatctcttcgtcagcttttctatattcgtcttcttaaaattcctcatactccgccgggtcttggccatttatgcgtccgtccgcgcgggtaagcgaatcgatgatcttcatgtcattttcatcaagggagaaatcaaaaacggagatgttttcaagctggcgctcgggcgatgctgattttggaatcgggatggcgcccagctggatatgccagcgtaaaatgacttgagaaatggttttgccgtatttgtccgcaatctgtccgagtttttgatcgttcaatacttctccggcgcgggataacgggctccatgattctgtcacgatgccctgttcctcatgccattgacgctgctgctgctgattaaaagcgggatgtaattcaatttggttaatgcctggctttacgccggtttcacgttcgagccgttcaatgtgttcaggcaggaaattgcagacgccgatggaacggatcaggccccattttttcgcatcaatcagtgcctgccatgcttccgtgtagcggtcttgtttcggattcggccagtggacaagatacaggtcatagtaatccagaccggcgcgatataaagattcttggattgtctgtaccgctttgtcatattcatggtagcgccccggaagtttggacgtcacgtataactgttctctcggaactgagcttctgcggatggcttcaccgaccatcccttcattttcatagttataagcagtgtcaatcaggcggtagccgatatcaatggcgctgttgacggcatgaacgccgttgttcctgttaagagcgtatgtaccgaagccgatcgcgggaatgcttgtcccatccagcagtttcttttgcggaattgctgcagtcatcattaaatccctccttggtttctactttaccattaatcttacaaatgaaacataataatggaagaaagtgagatgacctgcacatgaaaaaagctgacggaaaaccgccagctttatatttgaaacatccatgcaacgacggggccgaagaccgaccctaatacggcgcagagcgtcatggaaacagaactcatggagactgttaattctccgtattccatcgcttttgaggtgccgagcgcatgggaagcgctcccgaatgcgattccttttccgagtgaactgcggatgcggatccacttgagaagcagcgggcctaagatgacgccggaaaaccctgcgatcatgacgaacacgactgtcatggaagggaccccgccgattcctgatgcgatttgaatggcgaccggagttgtgattgattttggaatgattgacaaaatcaaactccggctgatgccgaacagttctgcaaataacaggccgctgaccattccggagaataaaccggccagcacgccgccgataatcggaaacatatacttgattaacatacggcgctgcttataaagcgggtatgccaaagccaccacggccgggccgagcagtgaattgatccattgtccgccgatcatatactctttatacgaaatatgaaaaacaagcagcacagcgattatgaaaatcgtagtcgtcagaacgggtatgagaaagggataaggaaagcgcacatataatttcaccatggccagataggcggcggccgtgaacaaaattataaggattgcgatacatgtttgctgcacttctttttctcctttctctgattggctttatgctctaacagctggctggcgtaccctgcggcgatcattgtgacgagagtgctcagcacaacgatcaaaaacagggccactccgcttgcggaaaacagtgacggataattgatgacccccgtcatggccggaatgaataacaacggaagaaaagacagcaaaaatcccgctccgtcttcaatcattttgacgggaatgatcttaaccgataaacatatgatgagcaggatcaaaccgataatgctgccgggaatgggcagatgacagagctgctgaatggctcccccgataaaggaaaatgcgaataaaataatgatttgcaatatgatgcgtatgactttcacgacgatgctgttctttggagaagagcagcttccccctttcttgttgcttcggtaagtttctttacttttggtgcatatatttgtactatacaaatatatgtatgcaaaaaatttctatatgttttctgagtaaatgtgcatatgtttgtattatacaactaatattgctgatgtcaattgtaaggagtgaagccgtttgtcaaaacaagatccgattgaattaattgaatatgagctcaccacttttattaggagggctgtttatcttgataactccgaccgcaaaatcggaaatctggaaagggcctcgtatttgttattacggcagctggatgaattcggaccggcgcgtgtgaaggaattggccgaatcctttaagcttgatatttctacattgtcgcgccaggccgcggccttggaggcgaaggagctgatccagcgtttatccgatccttccgacggacgggtcagtctttttgcgattacgaagcttggcaggcagaggttaaaagctgataaaaagatgcgacttgatcgatatgagcgcatgcttgatgattggtccggcgatgaaaaagaaatgttcggcaggcttttgctgcggctgaatgaggcatttatcgattagtgaatgatttttcccggttaagcaggattatggcgtatatgaaggagaatggaagagaggaggctttacgccattctgctttagctaaaattttatagaaaggggggcggaaaacatttaacccgggaaatagtgtttctcggagattgcagcttttattatctcaatattcataatttaataaaatgaaagcgctttaatttgagtattctggtttagggtgtaaggtgtttacctgaaaaaaacaattgtattttccacgaaaatttattatgatgagataaggaaattagagattatataacaataggaagatagaatatttctaatattgcgggaaatgaagattgagttaggttcaaacaggtgcaccttctgcttcattatttcacatatatctgagctgttaagaggaggaagcgaagtggcaaacaaagaattaaagagaggcttaggcgcgcgtcatatccagatgattgcgctgggcggcacgatcggtgtcggtttattcatggggtcatccagcacgattgaatggactgggccgtccgttctgcttgcttatgcaatctccggtatctttatcttttttatcatgcgtgcgatgggcgaaatgctctatgtagagccgagtacagggtcgtttgcgacattcggccataagtatatacatccgttagccggctatatgacggcgtggagcaactggtttcaatgggtgatcgtcgggatgtctgaaattatcgccgtcggttcgtatatgaaatattggtttcctgatctgccggcatggattcccggcattatcgccatggccattctcggtgcggcgaatttgatttcggtaaaatctttcggtgagtttgaattttggtttgccatgatcaaaatcgtaaccattattctgatgattgttgccggaatcgggattattttcttcggtttcggtaacggcggccatgcgatcggactatctaatttatggtcgcacggcggtttctttacaaatgggttctcaggatttttctttgcgttgtcactggtcattgcggcttatcaaggggtcgagctgatcgggattacggcaggggaagcgaaggaccctcaaaaaacgctgcgaagtgcgattcagagcattatctggcggattttgattttctacatcggtgcgattttcgttatcgtcaccgtgtatccgtgggatgagcttcactcactcggcagtccgtttgtttcgacatttgcgaaagtcgggattacggcagcggccggcttgattaactttgttgtgattaccgctgcgatgtccggctgtaacagcgggattttcagcgcgggacgcatgctttatacattgggcgtgaacggtcaggcgccgaaattttttaagaaagtttcttcgagcggtgttccgatattcggtacgcttgcagtattaatcggacttgtgatcggtgtcgtgctaaactacatcgcgcctccgaaaatttttgtctatgtctacagcgcgagtgtgcttccgggaatgatcccgtggttcgtcattttaatcagccatctcggtttcagaagagcgaagggcgctgagcttgataagcacccgtttaaaatgccttttgcgccagtgacaaactatttgacgatcgctttcttattgatggtgctggtcggcatgtggtttaacaaagatacgcggatatctttggtcgtcggggtgatttttctggcgattgtgacggtcagctattatgcgttcggcatcggcaagcgcatgcctgatgaagaatcgaaaatagaagacgctgtataactcaaaaggacacctctcttaaaggggtgtctttttcggcttgtccgcgagtggtatactggataaaaaaagcagaaccgggggaaacatcgatgagtcactaccgtacgttattatttgatatagacaatacgctgctggattttaccgcttcagaaaccgttgcccttcaaaaattgtttcaaggttcaaagctggacctgacggcagaggtggaggcccgttataaagcgttaaatcaagggctgtggaaggcgtttgaagagggtgaaatgacccgcgatgaagtggtgaatacaaggtttgcccttttgtttaaagaatacggcctcgaagcggacggcgtgctgatgaatcagacgtaccgccaatacttagaagaagggcaccagatgatagacggagcttatgagctgattgaaaggctgagtcctttatttgatttatacattgtgacgaacggggtgtcgcgatcacaatataagcggctgggcgactccggtctgtatccgttttttaaagatgtgtttgtttctgaggatacgggttttcaaaagccgatgaaggaatactttgattatgtgtttgcgagaattcccggtttttctgccgaacacgggcttattatcggcgattcattgagcgcggacataaaaggcggtcagatggcgggaattgatacatgctggtttaatcccgggaagaaagcaaatgagtccgggatcatcccgacgtatgagattcaatcgcttgatgagctgtatgatgtattgaaagtagaacgaaaagccgccgctcatctgtaaggagattaggatgaagattgcacatacgaagttactgatcaggggttttgcgttactatccatctttcatacgattcttcagcttccttccggccgggaggatctgaaggtttttttgtctgcactcgtggtgctgctgacggctaatgactgtctgcggccgatatatatgaagagacggcccgccatatataacggatcttttctcctgagcaacgtgatggcaggatttctgctatacaatgtctattgtgcggggacgcaggccataatggtgcttttattggtggaggtccttatcactgatcatcagatttcagctgttttggtaacggtgaacgccgccgcatttggcggagctttatatgccgccggagcgggtgtcagtgatattgtgctgccatacttcatcatgtttgcggtgatttatttatatcggaaaaatctgcaggagaagtcgaaggttgaattgctgaaccgagagctgaagacggctaacgccacattgaaggaatattcggaccgcattgaggaactggccgttacgaaagaaagaacaagaattgcgcaggagctgcatgattcgctcggtcattatctggctgctctgaaaatgaatttggaatttgccgggaagacagccgggcatcaaccggagagagtgaagcagatcattcataaggcgcatgatcttacgaaagagtccattttgaagcttcgccaggcggttacgctgctgcagggctctttgtcggggcgggaatttgaacaagcgctccgtgacattttcagccattttcaagaggcgggcagcatacgtttcgagcttgagatggatgcagccatagaggcggcacagccggatgtgaagcactgtctttatcaatccgttcaggaaacgattacgaatgcgatgaagcacggacatgcttcttatgtttccgtccggattcaaaaagaccggagcatgatagcggcgcatatttataataacggctcagcctgcggaacgatcgtaaaatcaaacggtctgaaaggaattgaaaaaagagcggccgcacttggcggagaagccgttttctcttccggaaatgaaacgggttttgacgtgaaaataaggattccgtgcaaggaggaatgatcaagtgaatgtcatgatcgcagacgaccagtctattgtaagagaggggctgaaaatgatcctgagcctccacgaaggaattgaagtatcaggagaagcttcctgcggcgaagaagttctcaatctgcttccgcaaactgaaactgatgtgattttgatggatatcagaatgcccggcatggacggaatcgaagcgacaaaagcggtaaaagccagatatccgtctgtgaaagtcatcattctgacaacgtttgaagatggacactatatttttgccgggctgaaaagcggtgctgacggttacatcttgaaggatgctgactcagatgaaattgtcgcctctcttcaagccgtttgtgaagggaatatgatgctgaatcccaaagtcacggttcaagtcgtaaaagcgctcaatcatatggacatccctgccgtgcaagaggaaccgaaaacaaatctgacggagattctcacgccgagagagcttgatgtggcaaaacacattatggaaggcaaaagcaataaacgcattgccgcagacttgtttctgactgagggcaccgtgaagaactatgtatccagaatcctcgataaacttgaagtgtcaaacagaaccgagcttactttatatttgcaaaaaatgatataacccccgcttcaccctcctctctttttatcttcaaacatatgacgaaagtaatatccatatcgagtacgaaagtgaatagaaaacaagaatttcaaagagtagaataagtgcagacatgacacaaggagtgctgcacgaatgctcgaattaaccgatttgacaaagaagtacggcgattttaccgccgtcaatcatatatcactgcgcgtcgaaaaaggagagatattcggtctgctggggccgaacggcgccggaaaatcaacaacggtgtcaatgatcagcaccgtgctctcaccgacgggcggaacaatctgcattgacggaacatcattacaggaacagcctgcggccataaaaaaagtaatgggtgtcgtcccgcaggaaatagccttatatcaagcgttaagcgcaaaggataatttggcttttttcgggagtctgtacggactttccggtaaggagctctataaacgggttgatgaagtgctggacatcatcgaattaaaggagcagcgcagccaaagggtgtctgaattttcaggcggtatgaaaagaagggtgaatatcggcgctgccctaatgaatgaaccgaaactattcattttagatgaaccgaccgtcggaattgatccgcaatccagacaccatattcttgaaaccgttaagacgttaaatcaagaaaaagggatgaccgttatctacacgagccattacatggaagaagtcgaatatctctgtgaaagagcggcgatcatggatcacggctcaatcattgcttgcgggacgaaagaggaattgaaacagtcagcaaaagcttctgataccctgattgtgaatgcagaggatctgaatgatgacgccgttcaaaaaatccgccgcattcccggtgtgtctgaggctgccgtcagccatcagaacatttctatgctcgtttctgcggcagatcggaatatccttgatattgcggatgatatcagaaaaaccggtatcaccatcaagggcattcattttgaggaagcgaatctggaaagcatcttcctccggcttaccggcaaaacgctgcgggattcataggagggcatcatgaaaacattattcaggctgattttattagattttcggttattgaccagagaaaagtctttctatataaaactgattctgtttccggcgctgatgatttttattttaggaacagtttttcacggcgattcgaaagtgaagtcatttcagatcacgttttataatgcggatcacgcggagagtcctttgggcgacgtattaaagaatgacgttctgaaacaaaatgatcttatccgtgtaaaagacataagcagttatcaagaagggaaacagcttgtcgaaagcggcaaagtctccgtttttgtatacgtgccgaaagggtttgcaaaagcggcagaaaacaatgaaaaaacaagtatcaaagtcatctcagaccaacaaggctctgtaaacggcgatattgttgaaatgatggccgattcgtttgttaccagagtaaaagcggcaaacagtgaggaaaaagcggtgctgaagcagtcgggacatctgtcaaagaaggatgtcagcagcataatcagcggcctttccagtgaacatgaacagactgtcaccataccgaaacggccggccggcaatcaagcggctccgattgatgcgatgcagtattattcaatcgcgatggtcgtcatgttctccatcatgaccgcgtttgcgcttattcacggcatagtggaagaaagacagcagcacacgttattcagaatcaaatcaatgcctgttttacatatacagtacgtggcgggcaagcttttgggaatcatgtttgccatccttgtgcaaatggctgccgtcatcatcgcaagcagcatcttgtatcaggtaaaatggggcaacttatttgagatattgctggttacgatcgtttattcttttgcgatcggcagtattgtgattctgtggggggttactgcaaaaaaccacgagaccgtctcaagcatggcggctcccattttgtatggattcagttttttaggcggaagctttatcacaaaggaaagtctgcctgacagtttgaaaatcgtgcaggagctgataccgaacgggaaagccataaacagctatgtaagtgtcacgcagcatgcaggtctgagcggtatttcggcggatttggcagagctttttgccatcggcgccgtgtttttatgtttgaccatatgggtgtttaagcggaaggaggctgtttcatgacgcagctgttattcatgatcagacatcagctgaaactgatgctgcaaaatcgggccgccatctttgcgacgatttccgttccgctccttctgacttatttcttttccttttctgcggatgacagtcagcagagggaagtatatgtggctgatgcggatcagagcgtcttttcaggacaatttatgaaaatgattcggacagccggccatgtaaaagtcacgaaggtaacggaggacgttttaaagacaaaagtcaatcatcaggatatttccttcggattgctgatcggctctcattttgaagagacattattttccggagacgaattgaatgtttcatttattcagaatgaagaaaagggtgatgctgttttgacagagcagctgattgcccagcaggcgggaaccctgaaaaaaatagtccgcgatgcaaaggtgatgtcccggacgctgcactctgacgggaagcagtcggcggctgatctgctgaaggatattcaggaccattctgccgtcacagttgaccgccatcacgtttatgcaggcggacaagcggccggcaggctcatcggttttttagtgatgtttatttggttcgttgcggtccaaagcttgcggtcatttatagatgaacaagaaaatcatacatatgcaagattgctgagtacgcccgtttcctatacggcatatgccatctctaagtttgcggcggcgtatcttttcggacttctgcatattatagtgattctcgctgcgggaaaattcatgctgcatatccgttttgccgatcacgttcttgctgcgggagcggtgcttgcggcctgctcatttgcgctcacttctgtaacgatagcagtaataccgtttatgaaaagccaaaagcaattcacatcgcttgcttccgtatttatagctgtcacgggtttattgggaggggctttcttcactttagattcggctccggattacatgcggacgctgtctttgtttacgcctgaaaaatgggcgatcggcgcgtttcaaaacaatgggggcagcagcacgcagattgcgccgctgagcctgtttcttgctgccggcgcagtgtcactggccttgtcactttatttgataaaccggaatttgaaaaaacatggttaggaggatggctgctttgtatatggcagaaataatcggaataatagaaatgctcgcgggagccgcaatgaacgtatggatcggcaagctgggaaaaacctttttcggtaaagatgacagaagttcgaggatcgtgttaagaatctgcggcatctttctcattatcaatggtgcttccagagcgtttcatatctagttcacaaagttttccggactattcacctaaatgtaatctttttccttgtaaatcatgtaaaatagtaagtgttctatgaaaatatgataaagggaggaagaaacatgaaaaagagaatcgttatgttatttgccgcggctgccgctgttttaatgctggtaagcggattgtgggccccgtcagcgtctgcggcgccggctcctgctttaacacaaatccgtattatcggagtgacctctgacggacagaattatcaatgggaaaatatcgggccaaaccaaatcagcgcatcaaaaccgatgaagggcactacgggttatttagcggtatacttccaaggatatccgaacaataacacgattcaggcgtttaacaacgggacgaatattacaaatcttacgtcaaaagcgctggaagatgaatatacgaaaaacggcaatatcattacaggctacattaaatattacagcgtccctctttcttatgtcagttcaggaacgttctctttctccgcaacggggctgaatgggccgtatacaccgttaagcagcggatttttctccattcaggtacagaattaaaacaaacacccggtgtgcagatgccgggcttttatgtatagtttttctctctttccgggaagctattcttaaagaagagggagggcttacatgatggacaggacactcgggtatttgcgcgagtcgctttcaaaccacttggagcatgacgtttgccgcgggatttataaaaagctgcaggtgaagcattatgcaaatgaaggtgagtttgtgaaagatcttaatgatctggaaatggatgcgttaaatcaggtgcttgagaaggaaatcaaatatgctgagaacgagcaggatgagaagcgcacaatggaattgaatgaagtatatgagcttctgttttaaaaagcctcccggctgacgggggcttttttttattgtttggaaacggtttacagtatcgaccgagtctttgtataatggatagttgtgacaaaaacagacggaggagaaaaatgaacgaaataaaaaaacagacggtacttgaattgtcatcggttgagaaagcattggtttttctggtgccgccattattggggctggtcatcggatggtttctgccggtcattgcgaaatgggccatttcattggattggctgccatttcaggggccgcttggaatcatcgcttcttttcacggatggaaggctgcggctgtgaccgccgttatcggtttattcggagggatccggctgacgagggctgcttttaaagaaagtcttgtggcagtcgtaacggatagagaggtgtccttaaccatacataatgaagaaagcgtgttttcaaaagacagcatttccggtgtgtttacagatcaaaagcagcttgttttattggggactgaagggcaggagctttttcgggaaacgcttgagccggccgttgaaaaagcagctgatgcatttcgcggtcatgggtatgtctggctggggacggaagatccttttaaagatgaatacaaacggtgggtgccggacatgccggatttggagccggtggcaaatgctcttttaaaagcgagacaaaaggcgctgaaacaggatgagaaggctgatgcgaaagaactgaaagctgaaatatccaaactgggcattaccgtgcgggatcaagggtcacgccaatattggcggatctataaaacgccgtctgcataaaaaaagctgcctccgttttatacggccgggcagcttggaaacagattatttcttcttgtcatcatagtattgaaccgggtacatggagccttcggataccattttgttgtcttcaatatcttcgggatgcgggttgcctgctttattgacgggaaatgattcaatatcgtgcttcccggaaagcgatgttttcatattgcggagaaagctcttcaccttttggcggtttgatttatctttaagcagataggaagtcactccgacagtcgacacggcaagtcctgaaatgagcagtttttgtttcataataaaaactcctttctatttctggcttgcagtatttattcccgcttggcggctgtttaaacatcgaaggggaattttggctttctgctttaatgcgataaagattgacaaatctattttcagaataatattataaatatatgatagtgctgaagtcatattttatgtgaaaggtgttaactttatgaatcaattacatcgcagaatgggaacgtttgcactcatgatggtcggacttgggtcgatgattggctccggctggttatttggggcatggcgggctgctcagattgcgggacctgccgccattatttcctggattattggtatgatcgttattctgtttatcgcactttcttacagtgaattgggttcaatgttcccggaagccgggggaatggttaaatacactcaatattctcatgggtcatttattggatttattgcagggtgggcaaactggattgcgattgtttccgttattccggtggaagcggtggcatctgttcaatatatgagttcatggccgtgggactgggccaaatggacaagcaatcttgttcacaacggcacacttacgggagaggggctcggctttgcatctgtattgctgattatttactttttactgaattattggacagttaacttattttcgaaggcgaattcattgactttaaaatcattattccggggctgacaatcggggctttgctgtttaccggttttcacggcggaaacttcacatcagggtcaagcattgcgccgaacggctgggcgagcgtgctgacggcggtggccacatcaggtatcgtatttgcgtttaacgggtttcaaagtccgattaacatggccggagaagcaaaaaatcccggcaaatcgattccgattgcggttgtcggttcgttattggtcgcaaccgtcatttacgtcctgctgcaaatcgcgtttatcggtgcggttgaaccttcaatgatcgttcacggctggagtcatctgaactttaactctccatttgccgatttggcgatcgcgttgaatattaactggcttgtcattatcctttatgcggatgcgttcgtatctccgtcaggaacaggtatcacctataccgctacgacgtcccgcatgatatacggcatggaaaaaaataagtatatgccgagcattttcggaaagcttcatccgctgtacggcgtgccgcgccaagcgatgatttttaatctgatcgtatcgtttatctttctgtttttattcagaggatggggtgtgcttgctgaaatcatttccgttgcgacactgatttcttatatcacgggtcctgtgaccgttatgacgctgcggcggacggcttcggatttgtaccggcctctccgtctgaaagggctcagcgtggttgctccgctcggcttcgtattcgcgtctctcgtgctgtattgggcgcgctggccgttaacggggcaggtgctgtttatcattttgatcggtcttccgatttacttctactaccaagcgaaagcgaagtggaaaggattccgccgaaactttaaaggcggcgtctggatggttgtctatctgctcagcatgatggtcatttcatggctcggaagtgaaaaattcggcggtctggacatcattccgtacggctgggatatgggactgatcgcaatcgttgcccttgttttctatacgtgggcgcttaagagcggattccaaacggagtatttgaaagacgctaaagcaatcaacgatcaattaaaaggcggacaggcggaagccgctgccggaaaagaataatgattatgcaaaccttgcggtaaacgtcccgcaaggtttttttatcgggcaaaaaacatgggttcggtatcatctccgaacccatgtggctcgatacaggttgacgatgaatgagaacaagcctaacgacagaacaatcaagaccagtattcttttttctcatatttctccgccttatcaataactgtcttccattaacttttttgtgaaaaatgacactctatcattaggcagctaattcaatacttaatactttcgatctgaaaagtatgaagccgggaaaaaatcccgttaaatagatcgacaaaatttgaaaaccaagcaaaattcacttattttgacgagtttgaaattttattgttagaattgatcatagatggtaaaaaattaaaatccactcctgtcagaggacttgaaaaaatgattaacaatgcccatgtttctgaatatgactttttatgattaagaaaaacaaagaagtatggagtgattagatacattttttaaatggctagacagcagagtgagtatacataagggaaattaaattcacaaaggagaataataatggatgagctagatcttgcttttggtattttatcactttctattatcgtcttatcgattatattcacttatattttcaaaaaggtgtatataatgccgcttgtcagtatagttgtttcagtcatattaatgttcactgtttttaatctatccttctggggatgggttgttgtctatggtttaatatcactggtattgtcatatattacaaatagtataagaaagaaaatagataatagaaataaataattatatcctttaatgcaaaccttgcggtaaacgtcccgcaaggtttttatcgggcaaaaaaacatgggttcggcattatctccgaacccatgtggcttcattatttatattcttttttgaccttttggaatatatccgcatagttggtgaacacaccggttacgccccaatccagcagacggcgcatgtccgcttcgctgtttacggtgtaagggtgcagcagcagtccgtggctgcgtatgttccggacgttttgagcgttcagcgctttgtaatccggcccgattccgacggcatatgttttgatgtccgttaaatctgcgtcagtcattgaagtcagctgttccgcttcaagcaattggacggcgggaagtttcggatcaagctttttgattttcagaaggctgtccttgctgaaagactgaatgatgacttgtccgggtttcgcatgctttcctgccaacttgtactttttcagtgaagcgatcagcttttcttccatacccggatacgtttcaggcgcctttgtttcaatataatagtttgcatgtctgccgaatcgttttaacacgtcatcaagtgtgggtacacgaagtcccgcgtattgcggttttgctttttccggataggccttattgaaccaagagccggcgtcgagcttttgaatctcggctaatgtatgatctttcacccagccgtgtccgtttgtggtgcgatccagtttttcgtcatgcatgacgatcagcttgccgtcttttgtcatttgtaaatccaattcaatatagtctgccttcattttttgcgcagtttcataagaaaggatcgtgtgctccggcacatagcccgaagcacctcgatgggcaatggtcaaaactctgtcaggagacaagagatttccttttcccgctgctgatacaggcgtgacgatgaatgacaataaaccgaatgaaagcaaaaccaaagcaaacaacttatgtttccgcatgttttcttcccccttaaaaaaatcaatatctgtctctagcgtagaagatagttgtaaatcctgtactgcaaaaatattaatcttttatgttgttttcttacgcatgctccgcccgtttgcctgtattccacgtcatcgccaagaagacgatggacagcaagcatgaggtgacaagcatgataaagcctccgttccagtcaaagcggtctacgacataacccatgatggcgttggcgaaagcggagcctccgatgtagccgaaaaacccggttaagccggctgccgttcccgccgcttttttaggagcaaggtcaatagcctgaagcccgataagcatgacaggtccatagattaagaacccgatgctgataagcgcgatattatcgacgagcggatgaccggcagggttaagccaataaaccaatacagcgataaatacaccggccatgaacagtacgcctgcaggtgcgcggcggcttttgaaaaaccggtcgctgatccagccgcacaaaatcgttcccggtattcccgcgtattcataaaggaaataagaccatctggaatcttcaggagagaatcctttcgcttccgtcaaataggtcggcgcccagtcaacaacaccgtaccgcacaaagtaaacaaacacattagcaaatgcgatataccacagaaatttattattcagcacgtatttaaaaagaatttctttggtcgtcatctctttttcctggtctttaaacgcatgtttcggatagtcattccggtattcctcaatcggcggaagcccgcatgattgcggagtgtcccgaacgagaagaacaatcacaaatgaaatgacaatggctatgatcgccggaaagaaaaacacgcttttccaagtaacaaacatagcgatgccgagtgtcacgagcggggcgagaatacctccgcctatgttatgcgcgacattccatatcgacattttcgtaccgcgttcactgatggaaaaccaatgagccatcgtccgtccgcaaggcggccagcccattccttgaaaccacccgttaataaacataaaaatgaacataatcgtcacgcttgaagtgacccatggcatggaaacaaataaaatgtttacgacacctgacaaaaacagacctgtcgcaaggaaatacctcgggttgcagcggtcagacaccatccccataataaatttgctgaagccgtaagcgattgatacggccgcaagcaccaagccaagttctccttttgaaaacccttgttcctgaagataaggaatggcgaaggcaaagtttttgcgaagcaaataatacccggcatatccgatgaaaatccctaaaaatacttgcagcctgagccgtttataggccgcatccgtctttgaatcatccaatctctcaatatgcggagccggcttgaacaattgaaacatcatatcctcccctttgctgaacgtctatcatgatgtatgtatgactcctttccttgaaaatgacaaaaagaaccagaaatcaccctcgtaaaagggcgggtttttctggctctcctcatctccatccaaaaatcattaacttgtatatgatagcgctttcttaaattatcacagtccggcgtgattgtaaacgctttaagaaaagttttcatttttttgaataaataaccgaagggaatatcagccggaacgcgaaaggatttgaagtactcgtttttgtactcaggcataagatgtgttaggccgattaaagaaaagcgaagggagtgcatctgttgattgatgaattggattttgcgttcggtgttctgccgctttgtatcatcatcttgtcagtcgccggaacgtatctgtttaaaaacgcgttcattatgccggctgccgctttggccgtttgtcttatatgcacctttaccgtgttgaattactcgtttatcgggtgggcctttgtgtatacgcttgtctctttcgcgttatcccatattacgatggtggtgatcagacaaaataaaaaataggatcggcggcagccgatccagctatcataagcagagatgaggctctgctttgttttatttatgaatgtgcaggaattccttaatgacagcggcatgttcttctttcggatacgtgctgtacagatggctggttaagcggacggggtctccgaagaagtatcgttcatattgtgtctgtctcgtgccgaaggggctcatggtcaaatcccatgccaggcggaatactttcacccgatcctcagcgttcaattcggccgcctgtaaatattggtcaaggtctcccctgatatctgaatggaacgctttttcagtcggcaaagttaccattccgcttgccccgatcagctgaatgatctccgtgaagcgcgggtagatgtcaggaaaaattgcgctgacaacacgaagcggaatgacactcggccgcatatatccccattcatctgtttccgcatcattctccgatttttccaaaagtgctttcatcgtttccagaccggtgatgatctcagccatctttgcatgaatatgctgatactcgctgacatttatcgtatcgacaatcgtctgggcaaggcccaggagaaactccgtctttacgatttgtctcgtgatgacttgatgaaatgcgaaggcgttaaaagagcttttcatattaaaatcaaaagccgcatcgtaattatcataataaaatacgcgttcccaagggactaaaacgttatcaaatacaacgatagaatccatttcttcatatcgtgagctgagcggataatcaaatgatgattttcccagtacgaaagattccctgcaaatgaattttactccctttgtattggatgggattgaaaaagcgaacgcttcatccgattcaaaatacatcttaggcagagaaacgacgagcacttcatctgtcagaccgccttgtgtggccaaaagccgggcgccgtgaatgacgaggcctttttcatttttttcgatgacttttgccgagataggggcaggtgacacgtttacacccatttgcgaacgatttacctggggggtgataaacgtgtgcgtaaaagaaagatcctgtgcaacagcgcgttcgtacagcgcctgaacatgttcaggaaaacaatgatcccggtctttcaaaatcgcggcagaagaggcgaaactcatcagcacggtattcatgtaatccgggctccgtcccatcattccatgcgtgtgcctggcccagtgctcgaacatttttcttcttctctttaagtcttcttttgttttcggctgcaggtatgaaagcccggcccgttcttttttgccgggaagactgtaagtcatctggtcttttaatcccggtttcgtctgcaaatcataaagagagcgcttcgtttccagaaggcccttaaatgcaggatgttcagaaatgtgtccctcgatcttttcaccgtcaagccaaatctcattctcaagccggtttaatcggtcaataaacattttgccattaatgatacccatcatgtcgcccttctttctttacagatccactacctcattatattgaaaacgaaatggggtgttccggttatttccaaaggggaagagcctttttcggctagggaggctgaaatgattgcataataaaaaccccttacgcagagggggtttttaactgatcatgtctttgtatctttgttcgaggacgaagtctatcattccggtgatacgggtgttttcagcgttttttgtaaagtgaggaattgagtgcaaaggtccttttttgtacagtttcagcagttttgtaagatacattaagcctctggcgaataaaaaaagcaggagatacggaaagaggcggggaacatgaacatagctgacttgacctgagaaaagtgctgtcagaaacatggcaataatgcttccgataaaaatccatttcataaaatcaaataatgagaagtcaggtttggaaaactgtttttttcagcttgaataacttctcggtatcctgttcttcaagacaattcatcatgtttacaagacctagtctgcttcatgcttatcatcacttttttcccgcttcttttgattcatttaaagatgttccgatataaaaaaggcgtgccgcggtgtaaaatggctatattgataaatatggaggttgagatggatcaagattatatgactgagcttgtctcggtccagctgaagaaaatccggtcggagagaggctatacacaagaaaaaatggcggatgtgatcggcctttctaaaaaggcgctggtgcagattgagaaagggcgggcgctcgcggaatggccgcatgttgtagcggtttgcgcgcttttcagatcaagtgaaacactgcaatccgtattaggagatgatccgctggaggtcattgaagcggttgctcaccgaaccattgacaggccgaaggggaagacgatgggcggcagggtgtggtggaaagccatcgagaaaaaaggcgagttccgcttgcagcagcatttgatttcccaccattaccgcatcctcgattcttatgatgatttgtggttcagcagttttgaaaaggcggatgctttagagcggcttgatgagctgtttttggaggcggaggaagcgaagcgctgacgcacctccggttgatgtattttctgacaagtgggaaaatacatataaatcccaaccaaaggagagattcgaatgaagcctgaagatatcgtgcgaagcggcccgaatcagtacatatgcaaggaagggatcgcaaaagaacttcccgggctgtcggaggtattcagaaaacccgttattgtgaccggaatcaagtcctatcaggcgtttgccgattacagcgggggttcttcctgggatgtgattcagcataaaggatactgttcacctgaggcggtgcgtaaggtctgtgagcaggcgaaaggtgcggatgtgatcatcggtatcggaggcggcacgattttggatttggcaaaagcggcggcagaccggcttgatattgaggctgtgatggttccttccattgcgggtacgtgtgcggcaagtacaccgttaagtgtcatgtatgatgagagcggcaattttatcagagtggattatcataagcgttccagctatttgacgcttgttgatccgctgtttttgctttcctctcccattgaatatatgaaaagcgggatcggtgatacgctggcgaaatggtatgaggctgaggcggtcatcagaaatacggaggcgccgccgctgatggctcaggcggggctgagacaggcggaatatattcgcgatctgttattgcgttacagtgaagcagccgtcgaaagcatggagaaaggcaggctgtcattgccgttcatccatacggcggaaacgatcattatgcttgcgggaacggtcggcgggtatggaggccgtttgtgcaggatggcaggggcgcatgcggtgcacaacgggctcagttttcttcaggagacacatcaggtgctgcacggccagaaggttgcttacggcatattggtgcagctcgcgcttgagaatcggagtcatgagattgaagagctgcttccgttttaccgccggctcggatttcccgtcagtctctttgatctcggcatccgtgacagccgtgaggaagccaagcgacgcatcgcttctcacgcctgccgggcggaagaatcattatgcttaatggggcaatatggcgagaaggacgtgtcagcggcgattgaatcgctcgaatcagcgcaaaagacaggatagagcttatgatctatcttgtctttattttttgaatatttccgttataatgagtggggtatagaaagggaggggccaaaaggacatgtatcaggcgaagaagatattgttattaggatcaggcgagctggggaaagaagtcgtcattgaagcgcagcggctcggggttgtcactgtagccgttgacagctatgagcatgcccctgccatgcaggccgcgcacaaaagctatgtgattgatatgcttgataaagcgcaggtcagagaagtgattgaaaaagaaaaaccagacttgatcgtgccggaagtggaggcgattgcgacggatgaactgctgaagcttgaagaagaaggctttcacgtcattccgaatgcgcgtgcggcaaagctgacgatggaccgtgaaggcatcagacggcttgcggcagagacgctgcatcttccgactgccggctatgaattcgcgaatacatatgaagaatgtaaagaagcggcggaaacaatcggctttccgtgtgtggtaaagccgctgatgagctcttccggaaaagggcaaagcgtgtgccgctcggcttccgaactaaaaagctgctgggacatggcgatggaaggcggacgggtgaaaaacggccgggtcatcgtcgaggaattcattccgtttgaatcggaaatcactcttttgacagtgcgtgcggcgaacggtacgtccttttgcgcgccgatcggccatgaacaaaaagacggcgactatatggaatcgtggcagcctcatcatatgacggaacagcaggttgaagaggcgaaacacattgcgaaaagcataacggatgagctcggcggatacggtttgttcggggtggaacttttccttactcaagataaagtgtatttcagcgaggtgtctcctcgtccgcatgatacggggctcgttacgcttgtgacgcagaatttgtcagagtttgcgctgcatgtccgcgcgatattgggatttccgattccggaaatcacccagctgtcgccgggggcaagccgtccgctgaaggcatcaaaagagcttgccgattatgcggttgaaggtttggagaaggctttggcggttaaaagcactcaagtccgcgtattcggaaaacccgtcacaaaaaacggtcgccgtatggcggttgcgctttctgcagccgagacggttgaagaggcgagagaaagagcggccgaagcactcagtcatttatcagtcacataactatatcttaagaggcgtttttaccgtaatggtaaggcgccttttttgtttggacagactatatactggaaaacggggttgtgagataatgtatgaggccgttttgtgccggctttataattcatgaaactttttatgtccgcaatcgttatatgtaatgttctcatttaacagaggagaaaataacaatacaccatatggtctttcatctgtgaagaacggacaatccgcatcgcggcatggaataaattaagcagggtaatccggaatagagataacgccgattgcttaccttaatatgaacggcgaaaaaacaaaaatcaccagattagattgttcaaataacaccaaatgctgtataataaaagaatttgaatgatagcattgaaggaatttcattttatgtttccttaaaatggagtctttatgcatacgcagtccgatttgatatggttttaattggaggtttgtgtaaactgtgaattatatacctagtatgattacaattggaaattttatttgcgggcttctatcgattcattcccttttgtatcataatattcactctgcggtgatttttattttcaccgggatgtttcttgatttctttgacggtttggccgcccgtaagctgaacgcggtatcggagatgggaagggagcttgactcttttgctgatctcgtgacgttcggcgtggcgccgtctatgctcgcttacactgtttcactatatacgcttccgttcatcggaattttaatcgcgctttcctacagcatttgcgggatgatccggctttcgagatttaatatcgaacaaagcaagctgccgacgtttatcgggatgccgattccttttgcgggcatgtgtcttgtcattttgagcttcatcaataacgcttttcttctgggagcgggaacgattgcgctcggatatttaatggtcagcaacattaaatttccccactttaaaaaacaggcgcctgaaaacctggagagcagaagatggaactagttcagcaattaatttccgattacggatatatcgcgatttttctcatgctgacacttggtattatcggattgcctattccggatgaagtcatgatgacgctagtgggctacttcacgcatttaaaagtgctcaattatgagctctccattcttatcagctttatcggagcgcttctggggatgatcatcagctacttcatcggcagaaaagccggccggccctttattaataagttcgggaaatgggtcggcctgaaggaaaagaggatggagaaagtagacaggtggatgaaaaagtacgggccgtacaccattattttaggttatttcatccccggcatcagacacgtgacatgctacttttccggaatcggcagaatggatttcaaaacctacctatgcttcgccgccatcggagcgtttttatggtgttttatttttattactataggaaaattcataggagtaatcaatgtttaatactgccgctaaagttctttatcgttcattgattgaactgactaataatcgattgacgtcttatctcattaaaaacttctgtgaatcgaaactgagcaagccgatgattccgctgttttccaaacactatcgcatcaactggaatgaaacggaacgcacagcttctgactttgattcactggcgtcatttttcattcgtgatattaatttgaatctccgccccgtggcaaaagagaagaacgccattgtcagtccggtggacggcgtcgttcaaacggtgggcatgattaacccgaatcaaaccttcatggtaaaagggaaagattattcgttcgccgaactgacggggtttaaaagcgccgatcacaaatacaacggcggctattttgccgtgctttacctgagtccgagacattatcaccgcttccattcccccgtcagctgcacgtatcagaagctggccgagcttgggaaacgctcctatcccgttaatacgatggggctgaagtacggaaaagatgtcctctcaaaaaattaccgctatgtgtacgagctgacccgagctgaccagcagatgctcatgattccggtaggcgcgatgaatattaactccatcgttcagaccagcaccggaaacaagcttgaaacgggtgaagagctgggctatttttcatttggatcgaccgttattttagtattcgagaaagatatgtttaccccttcggataacctgacagaaggccgcgaattacaggtcggccagatcatcggttatgcggagtcacaggaggaggcgtccgctttataaaagctgctcctcttttttatatggtgtaaggaagtgacaatatggcagaaaaggatttggcaaagctgatagagcagtaccagcatacgggcggccagcaagttcttgaagccgtgcgggacgcctgctggcctgtcgtcgaagcgctcatatcagagctggctgaagacagcgccgatgtcctgcgggaaaaaggccgtgaccgttttccgtttattatcggcaagtaccagaccgctgcgggcctgccgcttgagacctttttgcgcaatacgtatcggttttattttcagcaggtgttaaaaggcgaggcatgactggaagaaagagtccggacggaaatgttcatctttcgcccgttttcctgtatgatatagtagagtgtgcgtgatcattaatataattgaacagggtgtataatcatggaaaaacaatatagagttttactttattataaatatgtaaagattgatgagcctgaagaattcacggctcagcatttgaagttttgtaaggagctcggtctgttaggccgtattttgatttctgaggaaggcattaacggtacggtgtccggaacggttgaacagacggatcaatacatgaaggcgctgaaagctgatccgcgctttgccgatatgccgatcaaaattgatgaggctgacggacacgcgttccgcaaaatatttgtccgccataaaaaagagcttgtgacgcttcgcctcgaagatgatgttgatccgaatgtcacaacgggcaagcatttaaaaccgaaagaattttatgagaaaatgcaggaccctgacacgatcgtaatcgacgccagaaacgactatgagtatgacctcggtcatttccgcggagcagtcagacctgatattgaggcgttccgtgagctgccgagctggattgaagaacacaaagacatgcttgaaggcaaaaaaatcctcacgtactgcacaggcggcgtacgctgtgaaaaattttccggatggctgttgaagcagggctttgaagatgtatcccagcttgacggcggtatcgtcacttacgggaaagaccctgaagtgcaaggaaaactgtgggacggacagtgctacgtgtttgacgaaagaatcagcgtaccggtcaaccgtgtagagcatgttattatcggaaaagattatttcacaggcgagccatgcgagcgttatgtgaactgtgcgaatccggcatgtaataaaaaaatgatctgcacacctgaaaatgaatacaaatacatgcgcagctgcagtcacgaatgccgaacaaacgaacgcaacatgtatgtgaaagagcacgaaatgacccaggaagaaatcaatgaacgcctcgctctgattgaaaaagaagatcatgcggcgattgattaacagaaaagaccaccaatgaggtggtctttttttgtgtttacatactttctgttcggacgctctggtctgaagcggcggcgggtcctttataattgaaggctttttcccatttggatacgacgatgcaggcgaccgcatggcccggcacgttgacaccggttcgcgccatgtccatgacgcggtcgacaccggcaatgatggcgacgccttccgcggggagaccgacggcattcgcggtcgccagaagcacgacgagtgaccctgacggcacggcggcaatgcctttgcttgtcatcacgagcacaagcatcatcagaagctgctgagatagcggcatctccacatgaaaagcctgcgccagaaaaatacatgacaccgataaatagaggcttgagccgtcacagttcagcgataaacctgacggaaccacaaaggagacgacccgcttcgggcagccgtatttctccatccgatccatcagctgaggcagaatggtttctgtgcttgtcgtggaaaatgcgatcaaaaacagatcccagatcattttcagcacttcaaagtatttgattttaaagataagccccacaatcggaaacagaacgaaaaggatcaaaaacagcccgagaaatacagtgccgatcagcttcagcatcggaagcaaaagcgcgattccgaattgtccgacggaggcggccataagggcgagaacgccgatcggagcggtgaccatcaccatttgcgtcagcttgaacataatatttgccgttgattcaaagaaattcatgacaggtgcggatgctttgccgatgccggctgccgcgacaccgaataagattgcgaaaaagatgacggcgagtaggtcatttttcgccataacgtcaatgatgttaacggggataatatcaagaagcatttgtttcaggtcgactactttttctgtatagccggaaagctcgtgaatatcttttttagcaaggtgagagaggttaaggccgactccgggcttcagtacgtttgccaataacaggccgagccccagaacaagcgtcgtaatgacttcgaaccaaataatcgttttgatgccgagacttcccatctttttcatactgccgctgccggcggctccgataacaatggtcgaaaacacgatcggcacgacaatcattttaatcaggcggataaatccgtctccgacgggccgcagcgccatcccgaaatccgggaagaaatggccgatcaatgctccgatggctaaagcgatcaaaatctggaatgcgataaattttttcaagcgaatcccccttttacttgcgcatttcttacgtaattcgtgaagcaggcggcaaccaccttcctctctgccataaatttgtcacacattgactgtgtgaaagagaggattgctttacattatgtaagcgcaatcattgaatatgacacaaagtcctcattggaaaaaatgaagcggcataggataaagaaagaattttactcgaaaatattaaaaattttgataattatatgatatgatacggacaactgcatcctcatatatctgtgcatacacgattcggacagagaaaatatatgcagatcataaaagactgaaaattttaacaattataagaaaggtgtgcttttgttgaatcaactgattgaaatacgtaaggtcacagcaagaaaagaaaaaccggattccgcttcattgggatttggcaagtacttcactgattacatgtttgtcatggattacgaagaagaaagaggctggcatgatccgagaattacaccttatgaaccggttcatcttgatccgtccgcatccgttttccattacgggcaagccgtatttgaggggctgaaagcttacaggtcagaagaaggacgggtattgatgttccggcctgaccagaatgttaaacggctgaataaatcgttacggcggatgagcatgccgcctctcgacgagaagctggcgctggaagcattgatacaattggtggagcttgagcaggaatggattccgaaagaaaaaggaacgtcattatacatccgtccgtttgtgattgcgactgagccttctttaggagtccggccttcaaaccgttacaaattcatggttgtcctgacgcctgtcggttcgtattacggcgatcagctgaaaccgatccgtatttatgtagaggatgagtatgtgcgtgccgtcaccggcggagtgggcgatgtcaaaacgtccggaaattatgcggccagcttacaggctcagcaaaaagccgaagaactgggatatgatcaggtgctttggctggacggggtggaaaagaaatatgtcgaagaagtaggcagtatgaatatctttttcatcataaacggagaggctgtaacgccggcattaaacggaagcattctcggaggcatcacccgggcatctgtgatagagctgttaaaaagctggggcatacctgtcagggaagaacacgttgccattgatgacatttatcaggccgcaatgagaggcgaagtgtcagaggtattcggtacgggaaccgcagccgtcatctcgccggtcggcgcgctgcatattcacggagaaacgattgaactgaataatggtttgatcggtgaagtgtcagaaaggctctatgaaacgattaccggcatccaggtcgggaaggtgcgggattcgttcagatgggtggttgaagtataaatgtaaaaagaacccttgcgcggcagggttcttttttcggttattgggatttagcggcttgaacgcgggcggggcttttccggtttctcacataataagcgatgtaacagacggccataaatgcaattccgcaataaagggcgatggcctggttcggatcaaaagcaatgccgatacaggaggcgaggcacaggagaaaggccgctatcggcacggccgggtatcccggcgtccgatacttcagctctgaaacctgatgcccttctttaagaaaccgtcttctgaacaaaaattgcgatgcggcaatgctcatccacaccgccacgaccgcaaatcctgagacggagacgagaacaagatagattgtatccgctgcaaatacgcttgacagcagcgacagaatgccgccgatcatactgaagatcagagcgttaaaaggaatgcctttaggcgtcagcctggcaaaggcaggatgaagctctccctctttagacagggaccacagcatacgtgatgacgcgtacagccctgaattggcggcagacagaagcgccgttaaaatgacgaaattcatcagatcggccgcatagggcacgccgactctgtcaaataccgtgacgaacgggctttcaatcacaccggcttcctggatggagatcatgcccgacagcacaaaaatcgttccgataaagaaaagcgccagccgccagactgtggtcttaatggcgcgcggaacggttttttccggatcagcgctttccccggcggcgattccgatcaattccgtccctgaaaaggcaaagtttactgaaagcatcgtcatcagtatcgggaaaaagccatttggaaaaaggctgccgctaaccgtaaagttcgacagcataggtgcggcttcaccgcttttcatcgggacgatgccgaacatcgccgctcctcccaataaaataaacagtaagatggctaagactttaatgcttgagaaccaaaactccgattcagcaaaaaatttcacggagaagacgtttaataaaaagatgaaaagagcaaataccgcactccacatccacaccgaagtatgcgggaaccagcgctgcatgaagagcccggccgccgtgaattcagagcccagcgccaccgcccacgtcagccagtacagccatgcgaccgtaaagcccgtcgccggtccgatgtaggttttcgcataggtgtggaatgcgcccgtcaccggcatggccactgacagttcaccgaggcaaagcatgacgagatagacgatgcacgcgcccaaaaggtaagcgaaaatggtgcccgccggacccgcctgatgaatggtatacccagagcttaaaaacagccccgttccgatcacacctccgagtgagagcataaagaggtgtctgcttttcatacttctctgaaaatttgtctcgttcttgttgttcattgttttccaactttctgcgagggccgttctaataaaaaatctcatgccggcgaacggcacgagattccggcgaaccggctttttgaatagaatatacaaactattccgattagtcaagttgtttttaaagtcttggcccaatcggcaatggcctggatgtccgcaggtttcgtccggcagcagccgccgatcaggctcacgccgttttcgtaccagctttgcgcgctttttccgaaatggttttcacacgctgtgcctatccaggtttttgtcaccgggtcatattgttcgccggagttcggataggcgataatcggtttagacgctgcccgtttgatttcttctatcagcggcggaatatgttcaatcggtgtgcagttgatgccgatcgctgcgatttggctgcaggagtcgagcagagccgcgcattcggaaataggcgtgccctcgctgatatgccgtccgtctttggcgctgaagctgatccatgcataggtgccggggaattcctccagcagctttgtgatcgcttttgcttctgacaggcacggaatggtctcacaggccaaaagatcggcgccggattcgatgagggctttcatccgggggcggtgaaagctgatcagctcatcctccgtcagtccgtaatgtccgcgatattcagagccgtcggcaaggctcgcgccgtaaggtccgatagaagcggcgatcaaaggtttgggacggtgtatacggttttcttcatgcgcccaaaattcatcacgtgcttggacggcgagctcaactgatgtctgaataaggcggatcgcatcggtttctgggatgccgcgtgccgcaaatccttcaattgtcgattgatagctggcagtgatcgcgcaatcagcacctgcggcaaaatattctgcatgcacttgtttaatcagttcgggtctctccaaaagaattttggccgaccacagatcgtcatttaaatcacagcccatccgttcaagctcggtagccatcgctccgtctatgatcataaccggatattcatctaatatttgtgtaatgggattcataggcattcctctctgacttttctgaaaatatataaaaagagtaatagacgcttttctctttgtcaatgaaccggcagaaaaaaggtgttcaggacagctgcccgaacaccttttgtttaggaaatgtgtttgcctttcgcatttttagcgatatctgaatactcccagcattcgatcccgtcatcatcagggagcacatctctgtaaaagacggggtcctttccggctttcttttgccggacataatcgctcaaagcggcaaacgcttttttcgacagaaggaaaatcgcgattaaattcacgaccaccattaagcccatgaacaagtcagccatatcccacacaagctggactttggaaatgcatccgaacagaaccattccaagcacacagatgcggtaaatgaacagccattttttgttctggcttaaaaatccgatattggtttctccgtaataatagttgcccatcagagcgctgaagccgaacaaaagcattaagacggctaggaaacctgatgcccacgcgccgacatggtcgctcaaggcagcctgagaaagcgcgatgccgctcaggcccggctggtgataagcgtctgaaaataaaatgataagtgccgtgcttgtacagatgacaagcgtatccgtcaggacgccgaatgcctgaatgagtccctgtttcaccgggtggctcgttgtagctgtcgccgccgcgttcggggcgcttcccattcccgcttcatttgagaaaatcccgcgtctcacaccttgcatcaatgccgcacctaaagcgccgcccgctgcctgatcaataccgaaagcattttttacgataatcgacagaacgctaggcaattgggtgatgttcgtcagaatgacaaagaaagcgatgccgatatataaaacggctaagacgactacgacatattccgccatcttcgcaattcgtttgacgcctccgaaaataacacaggcgaagaccgctattaaaatgaggcccaatgtaagccggcttgtgccgaacgcgttttgaaaggcgatgctgatcgtattagactgaacggaattaaagacgatcccgaatgacagtgtgattaatacggcgaacagcgcgcccatccagcgttttttcaggcctttttccatgtaataggccgggccgccgcggaagccgttttgatcttttactttataaatttgggcaagcgtgctttcaacaaagcttgaagccgaaccgatgactgcgataatccacatccagaaaatagcacccggaccgccgagtgcgatcgcaatcgcgattccggtaatatttccggttccgacacgcgccgccatactgatgcaaaatgcctgaaatggggaaatgctgttttttgaccgggcggccgcgccttcttttaaaacccggatcatttccctcagcatgcggacttgcagaccctttgatctgaacgtgaaaaacagtcccagagaaagaagcagtacgattaaaagttttgaccataaaaaatcatttgctgaaccgattacattttcaaggaattcctgcatccaatcacctcttggttcgtttgattaaaaaatactgagctcccactcctgtgcgatatgtttcagcagcatgccgcccgtcaggctgttgccgtattcatcaatggccggaccataaatgccgatgccgcagccgttatgaaaaggctgttctcttctggcgcttggaggaaccaatgccataatgccgccggatactccgctttttgccgggacaccgacgaaagccgcatacttgcctgacgcattgtacatgccgcacgtcagcatcagggctttggcgagtttcgcgacatcttttggaatgacctgttcccggcggatcggatggtagccgtcatgcgcaagaatcaatccgattaaagcgatgtcctcggttgtaccctccatggcgcactgctttaagtagacttccagcgtttcttccacatccgcttcaagaaagttcgtttcttttaaatagtaggcgagcgccctgttccggtgcgcggtctgccattcagaacggaagacctcctcgtgaatgtgaggccgttttcctatcaatttttcaaaaacggaaaacaggtattctaatttatcatgcgccgtttcacccggaagaagtgaggcgacggtaatggcgcccgcattgatcatcgggttgaacggcttgccgggtttatggatttcaagccggatgatagaattaaacgcgtcacctgtcggctccacgtccacgcgatccagcacgtaagcaatgcctctgctcatgcaggccgcaataaagctgatgactttggagatgctctgcaatgtaaacgggacattccattcaccggcatgaatcacggagccatcaggctctaatatgcaaatgcccagctgagagtcgttgatttctccgagggcgggtatataatttgcgctttttccattaacggaaaacgggcggtaatgctcgacccaatcttgtaaaagtgaagccagttcctctttttcaaggcgctctctgaccatatctttcataacattcctcctctattgcaagcctgtccgcaagcggaaatcggtcttggaaaacgttttcaaatatagtgtgttcaattttaatgtataatgacatctacagaatcatacaaaatacgacaaaatcattcttaaaataagccgatagatttataaatcagcccgagcgtcccgctaaccgggtctaaagaaatttgcggactccttcggtcttattcaaaatagatagaagaaggaagtgattgtgatcaggctcgaatatttactaaaaaaagacggctatcttttcgcccttatgctgatcaccgtgccgctggcgggggaactgaaattttaccccgtaaatgaggtgtaccggatcagcttcggcgcgcccgcttttttcttttttctgcttctgctgcggcatgtgccggcggtattgtcagggctgttgacaggtgcagccgttgtggcattccggatcggcctggcttgctggggaggagagcatgccggctttacggaggcttttttcagccaataccccagtttctttttttactttacatatgcctgtttgttttacgtgctgaaagtcagacattttcgcgatcggccgctgatgatcggattcctcggttttctcattgaaatcgcgtctgacacggttgaaatggcggtgcagttttccggaggccagccgattatgataccggacaagctggcagatattgcggttatcgcagtttctcacacatttattgttctgagttttttcaacgtgatgaagctgcatgaagctcaggtcagggaaaagcaaacgagaaagcagcatgagcatatgctgatgatcgtgtctaacttgtatgaagaaacgattcatttgaaaaaaacgctgaaaacgacggaacatgtgacgaaggaatcctatcagctgtatcgggaaatgagcgggaacgaccgggagctcggcagccgcatgctgcgccttgcgggagaaattcatgaagtgaaaaaagacaatcagcggatattcgccggactgtcgaagctgatttcaaatgagagattccgggattacatggatgccgccgccctgatcggcctcgtcatccgaatcaatgaaaaatacgccgaatctttaggcaaggacattcagtttcaaagcgtgattgaaggagagcatcccgattaccatgtctttaccgtcctgtcgatcttgaataatcttaccgccaatgccgtggaggccatgggagacaggggtgagatccgccttacgctgcgcagggcggaggatgatacggcggaatttcaggcggaagatgacggtcccggcattccggaaaaaatcggagagatcgtctatgatccggggtttacgtccaaatatgatgaattcggcaccccttcaacgggcatcgggctttcttacgtgaaggaaatcgtaactgaacttgacggggacatctcctttcataacaagccaaaaggcgtcatatttacgattcagctgccggtgaggcatttgattgcagaaagggggagttcataatgcgcttttttatagctgatgatgaccgggcgatccgttctattttgagacagattatcgaggatgaggatttaggcgaagtcgtcggtgaggcggaggacgggagtcagattgaagggcattatctccattttaaacaagtcgacattttattaatagatcttctgatgccggggcgggacgggattgagacgatccggcatctgcagaattcgtacaccggaaaaacggtgatgatatcgcaggtggaggcgaaggaaatggtgggggaagcctattctctcggtattgaatattttatccacaaaccgatcaacaaaattgagatcatcaccgtcctccgaaaagtgaaagaccttatagaattggaaacgtccatcggcgacatccaaaattcgttaagacggcttgttcaccgcaatgaaccgcagcaaagccgccttcctgaagctcatgaaaaatccgttaaagagacggggaaatttctgttatcagaattagggattgtgggagaaagcggcgctcacgatctgatggccgtgctgcattttttatttgaggatgagcaagcgcaaaaaagcgttccgtcgctgaagcgggtgtttacaaatgtcgcgctgcggaaactggggcccgcggcgtcggaggcagacgtcagcagggagaccaaagcctccgaacagcggatcagaagagcaatcattcattcgttaaaccacttcgcttctctgggcacgacggatttttcaaatcccaaatttgaatactacgcttcgaaattcttcgatttccctgccgtcagcaagagaatgaaagaaatgcaggccaaagaaaccattccgctttctccggttaaagtgaatatgaaaaaattcattcacgtcttctttttggaggcgaaagatttacgcgaaggatcgaaatttgtcagcgggggaagccggtaacctgaacaatagagtttacttatataaggtctttgtgtaaaataatgttaactcaaaaaagaacggaggggtcctgatggcaaatcatattccggtttacgcactaatgaaatagtgtcaatgtctctgccttgagcgcggagaaaaccgggattgtctgcctgaataaaggaacctgacagttatagtgagggggcggcgattatgccgccctctttttggcgtcttcacatatctcatttttctcctcctcaggcgaagctctgtgtcagtaaataagggaaatggggaaacaaaatgacaaaacaaagggatatagaatccgttctgaacatcgcaaaggaaaatggcttacagttaaaatatgaaggggcagacataaatgaaacgggtatggacttccaagtcgtatttgctgaagatgacagcggcgtaacatgggtgctccgaaaaccgcgccgccccgatgttattgaaagagcggctgtggaaagtaacgttctcgcgtttctccgcagctatgccgcggtatcagtgcccgattggcggattcatacaccggaactgatcgcttatccgaaactgtgcgggatacccgccgccgcaattgatctggataagaaacagtacgtctggaatatggaacacgagccgccttcagacggttttgtcggctcgcttgccgcagcattagccgagctgcacggggcagatcctgccgctgcctccagagccggcattgaaatcataaaaccggatgatgtcaggcaaaggacagcggaatcgatggatcatataaaaaaagaaatcggagtttcagagccgctttggcaaagatggcaaacatggataaatgacagctcgtattggcctgatttttccgcgcagatccatggcgacttgcaccctccgcatatattaatcggcccaaatcagcgtgtgacgggtcttctcgattggacggaggcgaaggttgccgatccggccaaggattttgtcctttatcaagtgatattaggagaaaaagaaacgaaacgcctgattaagagctaccaagctgaaggcgggcgtgtctggccgaaaatgcaggagcatgtgacagaatggcaggctgcttatcctgtggagacagcgaagttcgcgcttcagacggggcaggaagaacatatgcaaatggcgcgggaaatgctcggcctgtctgattcgaaaggttattgacttccgccggatgacagcgtatgatactttttaaaacaaaagaacggatgaacaatgctgaggaagagtaagtacgcatctgcgcgcggggttcagagagtcggtggccgctgtgaaccgatccccgtccgatgccgaatgggcttctgaattgctgcgcttaaatgaaagtaggcggtgccgggattctttccccgttatcaagaaaggagtattgaaaccgtgttggttctgtactttttgagagaatggcttttcagccgttaataaaggtggcaccgcgaaaacctcgtcctttgatggatggggtttttttgtatcgttaaggaggtgatggccatggaaagtgactggagacggaccgaaaatcaaaaaaggagggatattcatggtgatcgcaaccgacgatcttgaactcacttgtccgcattgtgaaggaaccggcgcggagaaagaaggagcgccctgcccgaagtgcggagcgaagggcgtcattttgacggctcagggaaacacgctgctgcattttattaaaaagcatattgatcagtgaaatcaaacgaaaaaggccgtatccggccttcaggctgtcgagaacatctcgacagcctttattttcccttaaaatatcagacggtgtctttctcatgttccacacaagaaacgcttctcaaaacacagccgaattcgttctgcttggccaacttgtcgaagaggaccacctgcttcgaaaaattgataaatacatagacttctcattcatcgttgaaaaggccaaaccttactacagcgaaaataaaggccgcccctcacttgatccgctgatcttattcaaaatgatgctgaagattgccgcatacctgccaagcaaggccaggcgtgtgggagtgctttttctgcgcctgaaaaagaaacaggacaaaacataaaagcttgtagaaaaacatcattttctatacaagctgctttttcattcttcaaaataaggattcacatgaatgagcacttcttcaacatctgaaaagtgtcttttgatgtcatttcggatttcgcgggcaatatcgtgtccctgcttaatcgtcaaatcatgatccaaagataaccggacatcaagcaatttatagtggccgtgttctctcgctcggattttatcgagccgtttgacttgaggacaatgcaaaataaccgctttatattcctctatcagttcgggatcaacacttttttccatgagaacgtcaacagacggcctgattaattccattgaaatcttaaaaatgaggtacgccacgatgacactggcaattgcatcggcgtacaacagataggaccatccgcgtgtgttcccgataatcgccaataggacgccgataaaagcggcaagagaggcaacgatatcgcctttatgatcgtatgcaatcgctataatcgctttactgttccatgtttccccttgtttgatcgaataacgatataagatctgcttagccgcgtaggatatcagagccgcaaacaatgcgctgtattgcgggatgcttggaccttcaacaaaggacgaaatcgcttctattagaatatacacggaaacgagcactaatatgattcctacaatcgcttcgctgatgacctcagctttgccatgcccgaaaggatggtcttgatcgggcggcttattagaaatgccgatgacggccaggacagcaatcgaagccacgacatccgctgcagaatgtataccgtcggcaaaaactgcttcactatcgcctatcagtccaaaaaagatctttcctgccattaagatcagattggctatcaatgcaatcaaagcaacttttttgcttatttgttctctttcacttgccattttttcctcctataaaactgcacaaaaaaataggggcgcttttgatgcgctctccgtatcctttcttgtgtaatcactttgctcatcataccaattcagtttcgagtgggtctatagcaaggttgtttcctgtttactaataaataaggtgacagaaaaaaagttggagcagggctaaacagtacacatacaaaattgcgctgaattttaaaagtgaactattgacatttgagtatttatcttttattattatctcgaattcaagatattttaattcaaggtaatttaattagagtgcaggataagaacctgccgatcgtttgaatcacgaaaagatcagtgaagagaacgtttcgttttttgatcatatgctatttgattttttataccataatatctcgaattcgagataaagggggtacgagggaaatggctgaatttgtacagctagtgaatgaaagaagatctgcaagcaactttcttccagatcatccaatcacaagagatgaactcaacgaaatgttcgaattggttgcgttggctccatcagcttttaatttgcagcatacaaaatatgtgacggttcttgacccggatgtgaaagaaaagctgaagcaggccgcaaacggacaatataaagtgtttagctcatcagcggtgcttttagttttagggaataagcaggcatatcagaaagcggctgacatctatgaaggattgaagatgctggggatattaaataaacaagagtatgatcacatggttcaagacaccgtttcgttttatgaaaacaggggagagccatttaagagagatgaggcgataagaaatgcttcactttctgcgatgatgtttatgctgagtgctaaggaaaaaggctgggacacctgtccgatgatagggtttgatactgaagccgtgaaacagattttgaatatagatgatcaatttgagattgtcatgatgattacaatcgggaaagaaaaaacagaaagcagaaggccgcgcggctaccgaaagcctgtgaatgagtttgtggagtatatttaaatacttgtaagggagcggataaaaatggctaaaaaaacgatgggaatacatcatattacagcaattgtcggtcaccctcaagagaatgctgatttctacgctggagtgctggggctgcgattggtcaagcaaacggtcaattttgatgatccgggtacgtatcacctttattttggggatgaaggcgggaagccgggaacaatcatcacattctttccgtgggcggacgcccgtcaaggcatcattggagacggacaggttggcgtgacatcttacgtcgtgccaagaggtgctatgtcattttgggaaaagagacttgaaaagttcaacgtgccatacacaaaaatcgagcgttttggagaacaatatatagaatttgatgacccgcatggcctgcatttagaaatcgtggaaagagaagcaggggaggccaatacgtggactttcggagatgtaaccccggatgttgccattaaaggctttggcggtgcaaccctgttatcagcacagcctgaaaaaacaggtgaattgcttgaaaacatcatggggcttgagcgagtcggcaaagaaggagacttcgttcgttatcgttctgccggtgatatcggaaatgtgattgatcttaaattaacgcctatcggccgcggacaaatgggtgtcggcacggtccatcacatcgcttggcgggctcaggatgacgaagatcaattagaatggcaaagattgattgctacgcacggatatggtgtgactcctgttcaggatagaaactattttaatgcggtttacttcagagaacatggggaaatcttatttgagatcgcaactgatccgccgggctttgcccatgatgagtcacaagaaacaatgggcggtaaattgatgctccctgagcagtatgaaccgcatcgggctcatattgaacaagggctgctgccgtttgaagtgagagaattagattgatttatagatgaacgtgaagcatgaagaaaaataaaagacatacatttaacagatgtttgctggaagtgactgttggtaaacaagctgccttgcagcacatcatataatatgaaaaataaggagagataaaaatggaagatgcaggattgttgtttattcgaatcatgattggtgtggtgtttctgttttatggatcacaaaaattatttggctggtttggcggatacgggattaaaggaaccggacaatggttcgagtcaattggagttaaaccaggcaatgcagcggccgctttatcaggtctcggggaactcgcaagcggaattttatttattttaggtgtattcctcccgcttggagctgctatcataacgatcattatgttaggtgccattgtaaaagttcatggagcgaaagggtttgcgaacggtgccggcggttttgaatataacttggtgctgattgtagtctccatcggagttgcactcatcggttcaggggcgtacgctgtgcatttttaatataagtatctaagaacagttactgaaaagcggtaactgttcttttattttggaattttaagcattatttgcgggtgctctgcaaagcaaaaaaacggatatgttcaatataaatgtgtatagtgaatgtacgagtattgatgagcttggtcatgaaagacgagccgatttgaaggagggttttgatgaaagagctgacagacttacattcattagattctatcgagaattttattaaacagcatcaattcagttttatctacatttcaaggcccgcctgtacagtatgtcacgctgttctgccgcagctcagaaaagtattggatcagtttccaaatatcaaattggggcatatcaatgctgacgaggtagaagaggttgccggcagattttcagtcttcactgtccccgtgcttcttttatttattgaggggactgagtttctgagagaagcccgcttcgttcattttgaacagctcgaagaaaggctgaaaagggtttatcagttatatcaagatgtataaagcgtttatactttacaaataaaaagccccctttaaggggatcgggctgtcgagaaaatctcgacagcctttattttttccttaaaatatcagacggtgtctttctcatgttccacaaaagaaacgcttctcaaattcaaaacacagccgaatttgttctgcttaaccaacttgtcgaagaggatcacctgctttgaaaaattgataaatacatagacgttatcgccctaccccagggttgtttccaaaatggaaatttcattatgacagtgaacaagacagatccatttgtctaaatcaccaaacgcttacatacgcagcaactgaccgaaaaggatatcgatcatataaatcaaatcctgaaatctgttccgaatgcccatttctcgaacaatggacaagatcaaagaaccaccaaaaggtcatcacccgacatgtatgggaggatgataaagaaaaggtcagacaaaatcgtttgtctgtttcaggaaaaaacctctgcaaaaaaaagaaaaaatagagcgaaggtttgcagattcaaaacagctgcatgggtttcgctattgcaggttgggaaaacaaaatgtgagggaacaagttctcctcacagccgcatgccagacatgaagaagattgccgcatacctagtcaagcaaggctaggcatgcgggagtgctttttctggacctgaaatcaaatgaatatggaaagaaacggcataaaacaaaaaagcttgtagaaaaaacatcattttctctacaagctgaaggccgttatccggccttttttgcgttattcagatcggggctctaaaaaacgggacccgcccaagtcttttctcatcagatagatatggaaaaagtattctccgacagcaatgatgatggcggaaataagagcggcaaacgccagtcttcctcctgaaatgcccatggacagcggcattcccatcagccatacaacaagaaacgcgattccgaaatcagcggacgccgccgtaatgttattccatctcggcagcacgtaaagatcgcccgtaaagtaggaaacggctcccaacacaatggtcatcagcagcacgtcgccgaatgtaaagcggaaacctaagccaagtatcagatacagaataatgatggtcataatgcctttaatggcaagcgctttaatgtgctccatgcgaattcctccttatggaaatcatgttagtatgtttcctcatcatgtgaaatataaacctttttttcgtgaacatttgttttctggcttttgtctgtcatcactgggccgcggctgaatatgatgaaaggagtaaaaacgggaggtgtcatgatggcagtcgtaaaagcgtcgagcgccgatgtcgatctaatggcaaggctgctcagggcggaagcggaaggcgaaggaaagcagggaatgctgctggtcggcaatgtgggaatcaatcgggtgcgggcgaattgttctgattttaaaggtttgcgtactatcaggcagatggtatttcagccgcacgcgtttgaagcggtgactcacggatacttttaccagaggccgcgtgaatccgagcggaggcttgcccgccggacgattaatggtgaacggttttggccggctaaattcagcctatggtattttaagccgccgggagactgcccgccgacttggtataatcagccgtttgtcgccagattcaaatcccactgcttctatcagccgacaggcgaaacatgcgaaaacgtgtacaatacattttaatcccggacgcaccgttcttggaatgaacggtgtttttttaatttcttgtgaagaaaaataggaacaaagtgcgcttgacggatgaaaagccgaaaagaaacagagggggatttctcccggctgggcaaaggtttgtcgaaaacaatgtgaaaaatgtctcccgccgttcattttccggccttacaaatccttcacactcttcatagcggtttaacatttcttttttataatgagggcgatcaatgagaagaaaggggaactgacatgacacatgacggccgtttagatgaatggatcaaggaattggagaccaaaagctttcagaacaatacgtttgaccgccgcgcatttatacagggcgcggggaaaatcgccggtctttccctcgggttagcgatcgcccaatccatcggcgcgtttgaagtgaatgccgctccgaaattttctaactatccgttcaccctcggcgtagcttccggcgacccgctgtctgacagcgtcattctctggacgcgtcttgccccggacccgctgaatgggggcggcatgccgaagcaggctgtgccggtaaattgggaaatcgccactgatgaacatttccgccatatcgtcaaacgcggaacggagatggccaagccgaatctcggacactccgtccatgtcgaagcggacgggctcaagcccaataaagtgtactattaccggtttaaaagcgggcatgagctcagccccgtcggccggacgaaaacgctgcccgcccccggtgctgacgtgtccgccatgacgtttgcgtttgcctcatgccagcagtatgaacacggctattatacggcgtataagcatatggcgaaggaaaagcttgatcttgtcttccatctcggagattacatttatgaatacggaccgaatgaatatgtgtcaaaaacggggaatgtcaggacgcacagcagcgccgaagtgtatacactggcagattaccgcaaccgtcacgcccaataccgctctgatgccaatctgaaagccgcccacgccgcatttccgtgggtcgtgacatgggacgatcatgaggtggaaaacaattatgccaatgtcatccctgaaaaaggccaatcggttgaagcgtttgtgctcagacgggccgcggcttatcaggcttattatgaacacatgccgctcaggcgcatgtcactgccgaacggtcctgatatgcggctgtacaggcaattctcatatggcaatttagcctcgtttaatgtgcttgatacaagacagtacagagatgaccaggccaacggagacgggaataagcccccttctgatgagtggagagacccgaaacgcacattgatggggacagagcaggagcaatggctgttcgaaaatttagccgcctcaaaagcgaagtggaatgtgctggcgcagcaaatctttttcgcgcaatggaatttcggaacaaccgccaatccgatattcagcatggattcatgggacggctacccggctcagcgggagcgggtcatcaattttataaaaagcaaaaacctgaacaatgtcatcgtgctgacgggtgatgttcatgcaagctgggcatcaaacctgcataccgattttaatcaaacgaattcaaaaatcttcggcgccgaattcgtcgggacttccattacatctggaggaaacggggcggataaacgggccgatacggatcagatcttaaaacaaaacccgcacattaagtttttcaacgattaccgcggctatgtccgctgtacggtaacgcccgcccaatggagagcggattacagagtggtgccgtatgtgacggagccgggggctgaggtatccacgcgggcttccttcatttatcagaaagaccagacggggattcggaaggtctctcaaaacgcggttgcgggaggcttaaagcagtcaaacgaagtggaagaggatcgattcttcgcccataacaatgcgcacgaaaagcaaatgagaaagaaacgggtcaaaatctcacaataagggggcacattcatgttttcaaatatcggcattcccgggttaatcctgatcttcgttatcgctcttatcattttcggaccttcaaagcttccggaaatcggccgtgcagccggccggacgctgcttgaatttaaaagcgccgcaaaaacactggtctcaaatgaagagccggacaagcaggcggctgagaaagacaaaacggcaggctgaatcatgacacgggggcagacgaatccgcttctgcctcttctttcatataaggaggatgtacgattggataaaaaagaaacccacttgatcgggcatttagaggaaatccggcagcgtctcattaaaaccgtcatcgcctttctcgtgttttttatcggcgcctgctggtttgtgcaggatatttatgactggctgatcaaggatttgcctggcagactggccgttttaggcccgagcgagattttatgggtgtacatgatgattgcgggaatttgcgccattacggcaacgattccggttgccgcctttcagctctggcgttttacggcgccggccttgaccgcgtttgaacgccgcgccgctttgctttacattcccgggctttccgttttgtttatcatcggaatttccttcgggtattttgtgctctttccgattgtgctcggatttttaacacaattatccgccggccactttgacatggtatttacggcggataagtattttacctttatgcttaaccttacattgccgttcgggtttttgtttgaaatgcctctggccgtcatgtttctgacgcgtctggggatcgtgaacccaacccggctggcgaaggcgagaaagctttcatattttttgctgatcgtcgtctcggtgctgattacgccgccggattttatgtctgactttctcgtcatgattccgctgctcgtcctctacgaaatcagtgtgacgctgtcccgcatcgtttaccgaaagaaatgggccgagacgccgtctgccgcttagtgaagctcgcctccgccggtctcaatatcgtcctcatgcgccgcggcggtcaccgcggcgattttgagcgcttttgtgatgtgatcaaggctgaggctcggcgcggatttctgcaaggtttgttccggaatgtacgggatgtgtataaacccgccgcggatgtgcggatgatggcggctgatttcatccatcagcccgtaaaagagatgattgcatacaaacgtccccgccgtgtaggatacagccgcgggaatgccttcttttttaatctcctcaacgatccgtttgatcggaaggccggtccaataggctgcgggaccgccttgagaaatgtcttccccgacaggctggtttccttcgttatccggtatgcgcgcttcattcagattgatcgcgacccgttccggcgtgatctgcattctgccgcccgcctgcccgacacagatgataatgtcaggctgatgtttcttcatcgcttcgcgcagcacggcaagggacttgtaaaaaacggtcggaacttgttcggatacgatagaagcggggccttcagcggcaccattcagccgtttgaccgcttcccatgaaggattgaccgtctccccgccgaaggggtcaaagcctgtaagcaatacttttttctccatcaaaaaccctccttttctttttaccatactctataatggacatatattcctgccgaagggggaaacatgtcttgaattcgcctctgctgcaataccgacctttatttccggtgctccaaacacatacgatgctcgcgagctgctctcaaagcgctcttgcccggccggtgtcaaaagcgataaccgattatcaggaaagcctgcttcagtacggaggaaattgggaggaagccatcggacgcacggagcaggcaagatgtgagtttgcgaaattgatcggcgcccagcctgaagaaattgccgttttaccttcagtaacggctgccgcctctgccgtcgtttccgctttaccagattgccgaaagaaacaggcggtgtatacggaattggattttccggcgatcgctcacattctgaaggctcagaccgggatggagctttcagtgattccgtctgaagaaggaatgattccgttagagcggtatgagacgtatattacggagcagacgcttttcacctgtgtgccccatgtgtcatatacatccggttttgtccaggatatcaagcgcattgccgagatatccgcaaagaagggatcgcttctttttgtcgatgcttatcaatcggcggggcatgtcccgattgatgtgaacgagtggggagttgatatgctggccgcgggtgcgagaaagtatatgcttggcataccggggacggcgtttctttatgtcagaaaggaacttgccgaacggctgaagccgaaagtcaccgggtggttcgggcagcagcgggcgtcgatgctggatttgacccatttttcttatgctgacggagccaaacgcttcgagaccggaaccccggcatttatcagcatatatgcggcacaggcggctttatcccttttaaacgatatcggcacagattgcattcatcaagaagtaaaaaaactcagcgcatttgggtacgaatacgcttctgaaaaagggctgcgcctcgcaggcccgacgtctgccgatgacaggcccggcatgatttccatatgggatgaaaaagcggcggaaacggctgcgtttttgaaacggaaaaacatcgtatgcgcgcccagcgggcaaatcatccggctggcgccgcatttctataacacggccgatgaccttatttatgcgattgatgaactggctaaagcgcgcggtatataaaaaacagcagactcatggagagtctgctgttttcttatgagtgattcactttgacccgcttcataaagaaagcgctgatcaggccgataacggcgacaatcattgcgaagataaaggcgtgctggacgcccgcaatcagcgcgtgggagtatacggaaggatcattcggatttttcacggtgctcatataatccttctgaccggccgccatgatgctgaccgccaccgcagtgccaattgcgcctgccatctgctggagcgtattcataatggccgttccgtccggataaaattccggcggcagctggtttaacccgttcgtttgcgccggcatcatgatcatggaaatgccgatcatcaggcatgtatgaagcacgacgatcagaagggccgtcgaagcgccggtaatgtttgagaaaaaccaaagcacggctgccgtgatgacaaacccaggaatgacaagccacctcggcccgtatttatcaaacagacgccccgtcaccggagacataaagccgtttaaaataccgcccggcagcaggatgagacccgacgtaaacgccgtcagcatcagtccgctttgtaaatacataggcaatagaagcattgttgataagataaccatcatacagataaatacaatcacgactccgagaataaacatcggatagcggaaagcgcgcagattcatcatcggctgcttcattgtcagctgcctgatggaaaataagatgagcgctatcgcaccgacagtgagcgagccgataaccgtcgggcttgaccagccgcctgatccttcgcccgcattgctgaaaccgaagacgatgccgccgaatccgatcgtagacagaataattgaaagcacgtcaattttcggctttgtaatgtctgatacgttctgcatgtaggcgattccgaataaaagagccaagacaagaaacggcagggaaatccagaaaatccaatgccagttcaaatgttctaacacaagccctgaaaaagtcggaccggtcgcaggggcgaacatgatgacaagcccgatcgtccccatcgccgctccgcgcttatgcggcggaaagatgacgagaatcgtattaaacatcagcggcagcagcagcccggttcctaaagcctgtacgattcttgccgccaaaagaaacggaaagctcggcgcaagggccgcaatcagcgtaccgacaatggaaaaggcgagtgacacgatgaacagctgcctcgtcgtaaaccattgcagcagcagccccgaaaccggcacaagaataccgagaacgagcaggtagcccgtcgtcagccactggacggtcgcaggagtgatatgcagctccttcatcaggtcagtcagggcgatattcagcgccgtttcactgaacatgccgataaaccctgccgtcagcaaagaaatcatgatcggcatgactttatattgtttggaaggttgagcgttttccaaaatcattctcctctcttacatacgtaacatgtctctcgtattttatgtcctcagaaggctggggatttgttttgaaatatggatgatcggcattttgtcttttttggctaaggacaaaatgatgccgccttctatcatggcatttaaaacagtgctgatttccgccgctttctcatcagaaaaaccggctgatctcaatttgcccgcgaacagattctcccactcctgataagcgcactgacaggcctgctgaagtttttcgcttcttaaagcagtttcagcagccagtaaaccgacaggaaacccttcgaagttctccggacatgtaaattggcgtgataagtcctgtaaaaacgcttgaatgctttccgcaggatcaggataggcatcaaggctttcttttattttcatacggatataatggctcatttcattgacagcctcaatggcgagctgctctttgccgtccggaaaatgatagtaaagagaacctttcggcgcaccgctttctttaataatctgattcagtcccgtgccgtaatacccctgcagctgaaacagcttggttgccgcggcgagtattttttcacgagaatctccataactcattatgttcccaccttactgattgatgacaaatttaaatatagtgactggtctattatcgtgatttcacatggcggtgtcaaggatttttgaaacggatcttttctcaggaagattcaaaaatcgttaaggcatgctgtttttatatgatggaagaacaaaagcagggatagggggagttttctcttcatgcctgacagcttcaaatcctctcaactctcaaacagccgatgctcaatgcatctaggaaaagagaaccgggcgctctctcctttttttgattgccgtattaaagcataatcgtgctatcggaaaggggcgactttcttatttttccgctcttatttatttgtagaaaacagtaaataatacactattttttccttttctcaactaatagaatgaaaatttcaaaaatattacatagcaggaggaaagttcatgaaacaaataaaaagcaaaatcctagccattcttacagtttgtatgctgtccgtcatttccgtatttgccttccagccgaccgtatcaaaagcctcctcaggtcataatccggttgtcatggtccacggaatcggcggagcgtcctttaacttcgcgggaatcaaaacgtacttggcatcccaaggctggtcaagaaatgagatgtacgccattgattttctggacaaaaccggaaacaacagacacaatgcgccgagactgtcaaattacgtgaaaaaagtgctcagcgaaacaggcgcgaataaagtcgatatcgtcgcgcacagcatgggcggcgccaacacactctattacattaaaaatcttgacggcggggacaaaatcgcaaacgtcgtcacactcggcggagcgaacggtcttgtgaccaacagagcgcttccgggaactgatccgaaccaaaagattttatatacatcgatttacagctcagcggacttaatcgtcatgaacccgctgtcacgactgatcggcgcgagaaacgtgcagattcacggtgtcgggcacatcggacttttaatgaacagccaagtaaacgggctgattaaagaaggtctgaacggcggcggacaaaatacgaattaacagattcagagccccggatatagagaatttccggggtcttttttttcttccatattcttttttcaccgtaaaccaagccctctgaagttatttttgttaaaataataaagttatatcagaattcggagggtttattgtgggaaaagtgaaaagaaatgccccttgcccatgcggcagcgggaagaaatataaaaaatgctgcggaagtaaagcagctgacattccggcagacatcgcggcaaaagaagcgaaacagattcaggaaagcttaatggagtacgcttttacagcacatagagacggcatatcatcatttattaaccagcacgagttcattgcggagctggacagacagacaaaagacatcggcgtcttcaaccttggcatctggggaattttcttccggccgctggcaggcggcaagacgatttttgaagaatatcttcagaaaaaagccggcggcatcaaccgcccgaaaactcgggaaatcgttgaatcatggaaaagcatgacacctgccgttatggtgcttgaagatgtgaaagaaggaatgattcactttgaagatgtcatgacaaaaaaacaattcaaagtggaaatggacgtcagccagcaggatcttccgccggcgggaagcctgattctcggctatccgatccacgaagcggaaaaagcggagttcttcatgcagtttacgatcttccctgtgaagcggaccgaagctttgatcagcaaagtgaaaaaggcggcggccccggcccttgcggaaggaaaatcgcctgaacgctttatgcaggaggacttcgacactgtgctggccgctcttttaggaacggcggaagagccgaagcctgctgctgaagaaaaacaggcagagtgggcgaatgacatggagaaggagacggcggacgccattgaaaaaggtctgagcggggatgaatacccggctgagctggttccggccgttattgatctgtggaaaacattctgtgtgaaaaaaacaccgacgatcagaaagccggaagccttcgcggcagcggtcgaatattatgtgaacagcatttctctgaacggcgcgtccgtttctcaagccaagcttgcgaagaagtacggcgtcagcgcatcaacgatttccagccgctacaaagaaatcgaaggcgccctgcaggatgaagctgatcgcttcgccgcggctctgacatcttaatagcttaatagacggcaaaaaaaccttgaagggcaaacgcttttcaaggttttttctattgatgcgctctcaggaaggataattcctgccggctatcaaataataaaaagagcgataacaggaaggggatggagccatggatgagacacgtacgctgggcaggacggatttacgggtaaagcgtatcggctttggcgcaaatgcggtcggaggacataacctgtttccgaatcttaatgatgaaacgggaaaagaactcatccgcacagctttggatggcggcgtcaattttattgatacggcgtttatatacggcttgggtcgttccgaagagttaatcggtgaagtcgtcgcagagcgcggcgtgcgggacagccttgtgattgcgtcaaagggtgcgcataaagaggtcaacggacaaatcgagctggacaacagccgtgaatttcttcggagtgaggcggaaaaaagcctgaagcggctgaaaacagatgtgattgatttgtattacgttcacttccctgacggtaaaacaccgctggccgaagtggccggcacgctaaaagaactgaaggacgaagggaaaatcagagcgatcggcgcctccaatctcagcttccggcaattgcaggagttcaacgctgacggctatttagaggtttttcaatcagaatattcactgattcagcgtgaggcggaaaaagatctgctgccttactgtgaaaagaacggcatttcctttatcccttatttcccgcttgcttccggcttgctgacaggaaagttcacaaaagacacagtctttgaggacagccgaaagaacaggccgccgtttcagggagaagcttttctccaaaacttggagagagtggataagctgaagtccgttgcggaagaaaaaggcgtgcatgcagcgcatatcgcactcgcatggcttctctcgcagccggctgtggatgcgatcattcccggagccaaacgccctgaccagctgaaacacaatctcggcgcgcttgatgtgcaattaaccgaagacgaggttcaatatatcagtgacatcttcaagtgaaaataaaaaaggaaatagcctgcgctatttcctttcttgctgtcaggacgttttcaaaaacgcttctgtcaatccttccagatcggcgtctgtgtccaaataccactggccgcgggcgtttttcttcatttcgatttctttcgtcacggaagaagaagccggtttcaggcgcataaactcttctggatagacagaaagcagatggctgacaatttcgttttcatcagcatcgggatgctttccggcgtagtcctgcacacggtcttgcagccggcctgcaagcggagacatatcaagcggcgtcacttttgcttctaggacggctttgccgtctgacatggatttggtttgcaccttgagttctgtgtgttcacgcagcgctgatgacatggcgtcaataatagcggaaatggcttttgagtccgcttgttccttcgaaatgcctgctgaagcgataaagctcgctttcgccgattcctggtatgcggcggctgtcattttttcatttacaccggtcaggcgggtgaaatctttattatgccggccgtacagcatcacatcaatgtatgcggataatgcgtccgccggatcgggttttgctttcggagctgtgcctttgactttcagtttataagataaaggcttcgcgtcttttgcctgcggctgatataccaattcatatgatttgccttcgtcagccgtgaagtacagacttcccgtcactgtcttgtccgcatgaagcgtgccgctttgcatccggtcttccttatcggccgcagctgttttcgcgtcattctgataaagcgagaagtcgctgcttttgacggtaagcggatcattgcccgtatttttgacagtgaccgttactttcagtgcggtcgggtgttcagcatcgtctgaagtcacccaggccgtatcttttatttttactttcgccgtgccgctttccttgccgccgcttgtttcgctgctgcaagcggcggtaaatgccgtgagaagcaaaatgaaaaacacggcgctcatttttttaatggacatcttgttaccccctgttgttatgatggttgattcaatagtcatatagatgaacaggttaattatactagttttgtataaaagagtcttgatctttttggaagaaaaggaagtgttatgatgaagaaagaagaattgaaacagctggctctcagaatcggaaacgtacctcctggctacgagagtaatgtggaagaataccaggaagatgaggttctgttttggtgggaagacaagaacgatccggaagccggcatcatggtcgaattggaaccggacggaaaactgaaatacttatcccgtccggctttccggactgatcttgctcctcttttggaaacggacatagaagaacggatgcgggcgtttttagaaacccatcgtccgggggcattggctgagttcgaattggagaaaaaaagctccgtaaatgatggtgatgtaagatattcctatgttcagatggcttacggtctgccgcttccgctgaccgggttttacgtcgacctagctgtgacaggggaagtaaccggcttttcgtaccaagggaaggccgatgatctgttaagacccgggacaattgcggacaagcgggaagcatcggctcattttgtcaaacagattgaagcagagctgttgttcaccgtactgcatcagtccgtctatgtgcagggggatgacaagccccatctcgtctatgaaatcgtgtctccgacgcggccgatatctgctgacctgaaggaagagaatgaagaaatagaagagtatgaagagctggaacacaacacgcggccgtatgtctcgatttcacgccctgaacctgaagcggaaaagatgagcatcaatgacatgatcgggctgcatgacggtttttataaagatagggaaagcgatcttggggacggctgcatcggcatagcgtggcgtcgtgaaaaaacaaaatccgcacgggaagataaaagctttgaaagtctgtttaaagagcggaatgaacatgtattgaaaacaaggtatgataaagaatcaggccggctcaccggggtgatgtcatttatacaagaagaaggcgaaccggtgttttccgaggaagaatgccatcacatggccatccgctttttattcgccatgtttccggaagcggatcagtatttccgggttcaatatgatgagccggatgatgaaggagaaaacgcgggacttacatataaggcctgttcgggcggcgttgatttgcgattcggagaaggaagaatctgtgtcagcaaaaagacgggtcttgtcactttttatatgccgccggaaattgatccgaaagagcttgagaatatcgatcccgttccttcattgacaatggaagaggcgaaggatgcgattcgccggaatatcaaagcagagctcgcttgggaccgttacgatgacggcagcggcagaaatgtgtacaggctcgtatacaagccggttttcccgcggtttattgaggcgcatacgggggaagcgatcatgagtttaataggctgaaggtcataggtgttcggtttgggggttttaagtgacatgtgacatttgtatgaaaaataaccgccctgaatacggctctttcccctctttgctaaaaatagacacataaaaggcactttcttccctttaaaagaataaggtcatttttatataataaaaaacagttcttttttatacactcttcctgaaaggatgaccccattgctgaaagaacatctgagaaaaaaagcgctggagattgggaacataccgccgcactatgagcttgaaatagaagactttgatgaaaaacaaaaaacgagagcctattatatatggaaagatcgtaaccatccggaaaaaacggtaacgattgagctgggcggcgacggatctttgcttacatattcacgcaatgactgtccgggttcagaccttcagttgtcagacgccgaattaaagctgacggctctgcggtttgcggccagacaccgcccgcttacttttatgaagttcacctttcaggcgagggaagaacgaaatgggtgcatccgtttcatctatacaaaaaaagtgctcggccggccgctccccgattcgggttttttcgttgatgtaaccgagagcggcttcatcgtgcagtttctctattacggggataagggtgaagcgcccgtcccggaaaccttcgtcgatcaggagaaggtgatctcgcattatatgagcgggctgaccttcagtctcgtctatgacgttgtcaattttgagaaaacgccgcgccttgtctacgaaccgattctcccggcttacagctatccggccggagaagatgatatcgtgccggatcagccgttttgcgaggacaggaacgaatcggcaaaaccgcttcccgcgcttgaacataaacgggaagtcagcatcgatgaattgatgggatttaccgcggatatgattcagacgcgccggcgcgatctcggggatgagatcggaacgacatggcggaaaggggcagtcccggaacggaaagatttgagtatagaaagctattttgaaagcagcaacaaaaatacaatgaagatgaaaacggacaaaaagacagggaagatgacagcctttaaatcttttattgagcatgagggcccggccttttattcagctgaagaatgcgaggaaaccgcgcttcaatttttatacaagctttacccgagagcggacgagttttttaaaatgaatccgctgaaaacggacgggaggggacggttccgctaccatttttccgtatggcatcgggatattccgcttcggttcggtgctgcgagaatacttgtcagtcccgtaaccgggcttgtggaagcttacatggcgcctgatattgatccggagcagttagagcagatcaatccggtgccggccgttactatcgaagaagcaaagtccgcttttttatctgattttcatctgcagctggagtggcagcgcgattttacgccgtccggcaatgaaggatataagcttgtgtacaggcctgtatatcctccgtatattgatgcgcataagcaaaaaaagaaaaggttttattagccagggatcatttgtaaatgaggataatctttaaagtttctccaatcgcctccccaatcaaaaccgagcgttttggcaatcgatacgacctcaagccaatcgggcctgccgttttggtttccgtcgtacgtcatatcccaaatcaggctgccatcctttttttgcagggcgaagtcgatggcaaggccgtaattgtgatatgattctccgccttttgcgtaggtgacgatatttcctttttttgaacgtccttgacggtacaattcgttttgttcctcaattgatctgaaaccctctgtaatcacgacggtgatgccttttttcagagcggccgtctgcaataattccgcattttgtttaacgagcggatgaagagcatttggaatgcccctctcttgtaacgccgtttgcggcctcagctctttctgcacataggaaaaacataggtccgcggaaaagaagaggatcaaaagcaatgctattctgactggtaatctcatggtgaattctctctttctttaattgattaaaatctttgtttgctcactgtcataaatttgctatgataaaatataacataattagtagccggaggaaggaggcaaatctatgaaatccaagattccatctgaagaagtagccgtaaagatgaatgaatggtataagctgatccgcgcgtttgaagccgataaagctgaagcgctgaagcgggagattcaatatgaactcgaagatatggaagaaaatcaggatttattattgtatttttcattgatggaatttaggcatcgcatcatgctggataaattaaaacccatgaaagacggcgactgccagcctccgttctctgaaatgctcactgagattgagatgaaccagcaaaagctgaccggcttactggaatattatttttactatttcaggggaatgtatgaatttaagcagaaaaacttcatctcagcgatttctcattataaacgggctgaggaaaaactagaatatgtggaagatgacatagagaaagccgagtttctgtataaaatttctgaagtgtactatcatatcaagcagactttcttttcgatgaattacgcgggacaggcgcttgatatttacaagaaatatgaattatacggaatgagaagggtgcagtgcaaatttatcattgccggtaacctgatggacgcccagcagcatgaaaaagcgctggaataccttgaatgcgccttggagcacgcggagcggcttgatgatcactatatgattgctgcggcctattataatatcgggcactgtatgtacagtttgggtgacttttgcaaggcggcggaagactttgaacgagcggctgccggttttgaagcgcacagcttccagcaggtcatccaggctgttttttcactcacgcatatctactttaaaacggaaagatacagtgacgccgccgccagctatgcgcggggcatgaaaagcgcggcggagtgggaagacgagatctatatgacaaaattccgtctgattaaggagctttatcagggtgacggcggacaggattcgctcaaagagtattttgacattctggaatcaaaggagctgttggccgacactgaggaactgcttcaggacgcggctcatttctttcataaacgggagaactacaaagcggcatcttattttttcagcaggcttgtcggcgtgcaaaaaaggctgcaaatgaacaattacgcataatgaaaaagaacgggggagcttcggtttcgtcgttctttttatgatcccttctgttttcagccggtcaaaaccgggtacatgctctgtattaacatcagggaggaaatgagacaatgtatcaggatttacagggaaaaacagcgatcgtaacaggttcttcgaaaggaatcggaaaggccattgccgaacgcttcggcaaggagcggatgaatgtagttgtgaactacctcggtgattccgccggagcagatgaagcggctgacttcattgagaaagcgggaggccgagctgtcaccgtaaaagccgatgtatcttcagaagaagggattcaggcgctgtttgatgccgcacaagagcacttcggcggtgtggatgtgatggtcaacaactccggctttaatggcgccgaagcgatgccccatgaaatgagcctggaagattggcaaaaggtcatcgacgtcaacgtgaccggcacctttttgggggcgaaagcggcccttaaccatatgctccagcgcgggacaaaaggaacggtcttaaacatatcgagcgtccatcagcaaataccgcgtcctgaaaacgtgcagtacgcaacatcaaaaggcgggatcaaaatgatgacggaaacgatggcgctcaattacgcagacaaaggcatccgggtaaatgccatcgctcccggcacgatcgccacggagtccaatgaggatctgcaagatgaaacacacaaacagacccagctgaaaaaaattccgatgaacgccttcggaaaaccggaagaagtcgccgcggccgccgcatggatggtgtcggaagaagcaagatacgtgaccggaacgacacttttcgtcgacggaggcatgacgctttatccgtctcagctggaaaggtaaaagaggaggggaaaccttctcttttttgtttagggaaggatcataaaggaaatggttccctaaaaaaacagggggatcacaagatggcgaatgactggtggaaagacgccgttgtctatcaaatctatccgcgaagcttccaagacacgaacggcgacggcataggcgacctgcggggggttatcgcgcgtctcgattacataaaagaacttggcgctgatgtgatatggatctgcccgatttacccgtcgccaaacgtcgataacggctacgacgtgacggatcatcaagcgattatgaaatcttacggaacgatggaggactttcacgatctgcttacggaatgccgcagccgcggattaaagcttgtgatggatttcgtcttaaatcatacatccacagagcatccttggttcaaagaagcggaaatgaatccgaacagcaaataccgtaaatattatttttggcggccgggcaccgcagacggcccgccgaccgattgggtgtcggattacggacaatccgtctggcagtacgaagagcatacaggtgaatattacctgcatatgaacgccgtcaaacaagccgatctgaattgggaaaatcccgaaatgcggcaatcagtgtacgagatgatgagattctggctcgataaaggcgtggacggattgcgtattgaccagctccatcttctgtcaaaaaaagaatacctgccgccgtatgaagattatatcgctcgccgggctgatccgaagcctttccggccaaacggagcacggatacatgattacttaaaagaaatgacgaaagaggtattttccaaatatgacgtgatgtcggtcggcgaggccggatcagtgacgcctgaggaagggctggtctacacgggaaccgatgagcatgagctgaatatgatttttcattttcagcatatggagcttgatcagaagccgggacaagagcattgggatgtaaagccgcttgagctgtctgacttgaagaaagtgctcacagactggcagaaaaaacttgagcaccaaggctggaatacgctgtattggtgcaatcataaccagccccggatcgtatcccggttcggagacgaaggcaaataccgcaaagcatccgccaaaatgcttgccgccctgctttatttcatgaaaggcacgccgtacatttatcagggagaagaactcggtatgacaaacgctccgtttgacaggatagaggattatcaggatattcagaccgtcaatatgtatcacaaaagggtatttgaaatgggccgtgacagagaggaagtcatggcgtccatcatggcgaaaagccgcgaccatgcccgtacaccgatgcagtgggacggaagccgaaatgccggatttacagaaggagaaccgtggctgaaggtcaatcccaattacaaaacgatcaatgcagccgaggctgagaatgatcccgattccgtattgaacttttacaaaaaactgatccgtttacgaaaacagtatgctgacgtcataaaaggcagctacacgctgctgctccctgatgacccgcagctgtttgtgtatgaaagacaggcaaacggacaaaagctcatctctatcagcaatgtatcaaaagaagaagccgccttttattggccggacggttccgagcctggaagtgcgaaactgcttctcagcaactatgaaaatgccggaagcgcggattcctgcataacattccgtccatatgaaacaagagtctatctgcttgcctgatcctgagcagtcttgatccgcttggcagccgtcctcgtttcttttgtaacggggatgcttccttttgctttggcgagaccgaatgccggcatattgacatagatggattcataactgccagcgggaactgtatatgtttcatggtatataccgaccgcttgagatgcggccgcgcgctgataaaaatgccgccatgctttcatatgtttttctcctttggcgtaggacataaggtcatcaaaagagcgccaatattggatcagtgtaatgcttcgtaatgtacaggacatttccatagagagaaagccgagctccttattggcatacaattctttaatcattggcgtcattgctcggacaacaggaagccagcgatgtattgaaggccatttgttaattcgaacaccgataataaagacgacggtttcttcattggagcgggctgttacctgtgaagcggtgatcatctgttttttcatttaaagctcatctcctttttgcagtttgctgatgacggcatctgcccactcgatcgcggccgctgtcactcgtttgccgtagtcaatagtaaacagcctaagctccataccatcccgttttaaaagtgattgttcgattgtttcatacagttcatatttcatattgagctggagtttatagtgctctatcatccggatatttgaggcagtgtcttgtttatcgctgaaaaaaagcttcagcagcaactcatttttttcggcagctggctgcttgaccggctcgttcagccaatcctgtaatgcatcttcacccttttgggtaaggtggtattcttttttgtcaggacggtcttcttgaacggttgttgtcaccgtcagcaatccttcttctgtaagccgttttaaattaggataaatctggctgtagctgatggtccaaaaatgctgcaaactccgatccatcatttgctttatttcataacccgtgtgacatcctattgttattaaaccgagtaaggcgtaataagtatcagatttcttactcaattttcaccctcctatatattcaatagatatatatcaattagatataataataacggaaacatatctacacatcaattcttttcaaaaaatatcttgcaaaacgtaattacttcgttttattatggtataggaacaaatgaacgagaaagtacaaagtacggttcggaaatcgtcatcattctgatttacaggacagggggaaacgagcttgtttaaaaaatggagcggaatcattgtcattgcagcatgctttttaattgcggcgggctgcggcaattcatctacaaaaggttcgtcaggttcttcgaaaaacggcaaactgcacgtcgtgacaaccttttatccaatgtacgaattcacaaaacaaattgtcaaagacaaaggcgatgtagacatgctcatcccgtcttcggtcgaacctcatgattgggagccgacgccgaaggatatcgccggcattcaaaacgccgatcttttcgtttacaacagcgaatatatggagacatgggttccctcagcggaaaaaagcatgggctccgatcatgcgaagtttgtaaaggcgtcaaaaggaattgacctgctcgaaggttcggatgaagaggaagaggagcatgatcacggcggtcatgaccacagccacagcatggaccctcacgtttggctgagcccggttcttgcgcaaaaagaggtcaaaaccattacggcgcagatcgtaaaacaggatccgaagaataaagcatactatgagaaaaacagtaaagaatatattgcaaaactgcaggatcttgataaactataccgtacaacattaaataaagcggcgaaaaaagaattgatcacacagcatgcggcattcagctatttagctaaagagtacggtttgaaacaggtcgcgattgcaggcctttctcctgaagaagagccgagcccggccaaactggcagagctcaaaacgtttgccaaaaagcatgatgtgaagatcatctactttgaagaagtcgcatcgcctaaagttgcagatacacttgccggtgaaatcggcgcgaaaacggaagtgctcaatacactggaaggtttaagccaaaaagaacgggataaaggcatcggttatatcgacattatggagaaaaacctcgatgcactgaaagattcgctattggttaaataacatagtgtgcgccgcggggtgcacactatttctatgcgggaaaggaagatcagcatgaatctcgttacattacaggatatcgtttttggttattcgcatacacccgtgcttgacggcgtgtcgctggaaatcaaaagcggcgaattcgtcggcattacagggccgaacggcgcgtcaaaatcgacgctgatgaaagtcatgctcggcatgctcagaccttgggaaggaacggccgagatcagtaaaaaaaatgccgccggaaaacgcctgacaatcggctatgttccgcagcagatttcttcatttaacgcaggatttccgagcacggttcttgagcttgtgcaatctggccgttatacgaaagggaaatggtttaaacgattaaacgaaacggatcaccacgaggtggaaaacgcgctgaagatggtggaaatgtgggatttccgcaaccggaaaatcggcgacttatccggcggacagaagcagaaaatctgcattgcgagaatgcttgcgagcaatccggatctgctgatgcttgatgagccgacaaccgcggttgattatgaaagcagacagggcttctacgaatttatgcaccatcaggtaaaaaatcacaaccgcaccgtcgttatggtgacacacgaacaaaatgaagtccagcagtatctggataaagtcatacggcttgagaggggggaaaaaggcggatggaaatgtttgacttggaattcatgcgacgagcttttctagcgggaagcatgatcggaattatggcgccgatattaggcgtatatctcgtgctgagaagacaggcgctgatggcggatacgctgtctcacatttcattgtccggcgttgccatcggcttttttctcagtaccaatattacggcggcgagcatcgttgtcgtcacgatcggagcgatcggcatagaatacatgcggcgggcataccgtacatattcagaggtctctatcgccatattaatggcggccgggctgtcgtttgcgatgtttctgatcagtctgtcaaaaggcggcgcgtcgatgagcatcgatcaatatttatttggatcgcttgtgacggtcagccagcagcaggtctatattatcggcggcattaccctgctgattctgctttatttcattattttaaacagaccgctctatctgcttacctttgatgaggcgacggcgaagacatcaggcattaacacaaatctcttgtcaatgtccttcagcatcgtgacggggcttgcgatttcggtcattattccgattatcggcgtgctgctcgtttccgcgctgctcgtattgcccgcggcttttgcgattcgtatcgccaaagggtttaaatgggtgtttacggcagccattgtcatttctctgttcagtgtgttcacggggctgacgtcttcttaccagctcggaacgcctccggggccgtcaattactctactgttaatcattctgcttctgctcggctttacgctgcaggggatttggaatgcgtttaaaaaaggaaaagaacgaaaaaaccgccgttaagcggggctgcagtctcatctgccgctccgtttaacggctttttttatagaaataaatcagcgagacgttcgtatgattctttttttgcttcaaagtcaaagacgttgcagagcaccatcatctcttttgtctgataacgatctgacagttcaagcaggtggcgtctgactgcggcgggagagccgatcaccatccgcttcctgttttcttctatctgcttacggtcctccggggaatacgggtaagccttcgcttcttcaacactcggcacacggctgtcggcccctttcccgacacgaagcagccataaatcctggcttaacgcgagttcttccgctttctcatccgtagccgcacatatgacgaaaatggcacagagagaggcgggagcggaaaaatgggcggaggcccggaaatgatcctgatagatctgaaaggctttttccccgcgttccggattaatgaaatggccgaaaacatagcccgcaccctgctgagccgcgcgtctggcgctgttttctccgaggccgagcacccatagctgcggggctgtttcaatcaaaggcgctgtctttattcctgcataatcatgatccgcagggatagaatctgtcagaaaggatgataaatcctgaagctgtctgttgaactcggtcatgcttttcttgaccccgtctgtgagggcgagccggattttcgtcgtgccgccaggtgagcgtccgaccccaaggtcaatacgattcggatgcagcgcctcaagctgacggaatgtttccgcgactttataggggctgtactgcggcagcagaacgccgcctgagccgatacggatggacgttgtggccgcggcggtatgagccatcataatttccggcgacacgcttgcgagcccccttgtgccgtgatgctcggcaaaccagtacctcttatagccccatccttcgctgaggcgggcgagctccgcggaatggcgaagcgtctcgtgcggcccgtttcctttggatacgggcgcctgatcaagtatgcttaaatcaatcactcgtctgcccctttcctgaatgtattgatacaaggatagaaaaaatggttcgtccccgtcaatttctttgttttctctattctctccggaatgaaggagaatatagaaagtgaattttcgccgtttttcgtcaaaaattcttatgttttatgaaactttgatataataaaagacgtatatcttaataaataccgggatccttatcccggaattttgtgaaaatgcgcacttgcggcgtgcttatcggcacccttacagaataggagtgaatcatatggcgatctctttacaaaaaggacagcgaattgatttaacaaaaggaaaagcaggcctgtcaaaactgctggtcggattgggctgggaccctgtatcatcgggcggctttttcggaaagctgttcggcggaggcggtgccaatatcgactgtgacgcttccgtactgatgcttgaaaatgataaaatgacagacagcaaaaacgtcatctatttcggcaacctgaaaagccggtgcggcggtgtcgtacatacgggtgacaacctgacgggagaaggcgacggcgatgatgaacaaattctcatcgacttggcgaaagtgcccgcacagattaataaacttgtatttgtcgtcaatatttatgactgcgtcagacgcaaacaggacttcggcatgattcaaaacgcgttcatccgcgtcgttgatcaatctaaccgcgaagaattggtgacttacaatttaagagataactattcaggcaagacgagcctgatcgcggctgaaatctaccgtcaggacggcgagtggaaattcgccgcagtaggagaaggcacaaacgatacaaaaatcggcgatatcgttaaccgatacgcctaaacgaaaaaaaggagagtgcacacatggcaatttcattggcaaaagggcaaaaagtagatttgactaaaacaaatccgggtctttctaaagtcgttgtcggccttggctgggatacaaacaaatacgacggcggacatgattttgatttagattccagcgtctttctattaaatgaagcgggaagatgcgcgtcgcctgatgatttcattttctataatcagcttgaaggcggaaacggttccgtcgcacattcaggcgacaacctgacaggccagggcgagggtgacgatgaaagcgtaagagtcaacctgagtgcggtgcctgccgctattgacaaaatctcatttgtcatcacgattcatgaagcggaagcgcgcggccaaaacttcggacaagtctccaacgcgttcgtgcgcattgttaatgaagaaacaaatgaagagctgatccgctatgatctggctgaagatttctcaatcgaaacagccattatcgcaggggagctctacagacataacggcgaatggaaattttccgcgatcggctcaggctaccaaggcggactggcccgtattgcgacagattacggccttcaaatcggctgaaccatataaaacacagaagggagaggacggcacatggctattcaattgtcgaaaggacagcgtgttgatctgacaaaaacgaacccaggccttacaaaagcggtgatcggcttaggctgggatacgaacaagtactccggagggcatgattttgaccttgatgcgtcggcttttctggtcgatgcccatgacaactgtgtaaatgatcttgattttgttttttacaataacctggaacatccgagcggcggcgtcatccatacgggagacaaccggacgggtgagggcgatggagacgatgaacaaattatcgtcgacttcacaaaaatacccgcaaatatagaaaagatcggcatcaccgtcacgattcatgacgcggaagcgcgcggccaaaatttcggacaagtctcgaacgcgttcgtgcgcgtcgtcgatgaaaacaaccagaatgaactgcttcgttttgatttaggggaagacttctcgattgaaacggcggttgtcgtttgtgagctttaccgccatggggctgagtggaaatttaacgccatcggcagcgggttttccggcggtctggcatcactgtgccggaattacggcttgcaggtgtaagcaggaaattaccgttttactaaataggaggaaaaaacttggattttctacatcatattatgtcgacctacgcttccttttttgattggaaaatgtggggtgaggtgctgactgaccctgtatcatgggggctgatcggttccttggttctgctggaaggcctgctgtcggccgacaatgcgttagtgcttgcggttatggtaaggcatctgcctgaaaaacagcgaaagaaagcattgacgtacggattgttcggagcatatattttccgttttatctttatcggaatcggaatgctgctcattaagttctggtggatcaaagtgcttggcgcgctgtacctggcttggctcgtcattaagcatttctggatcggagaaggtgatgacgatacggaaggcatgaagaaaaattcttggatggtccgtacgttcgggattttctgggccactgtcgtttcagtggaactgatggatcttgccttctctgttgacagcattttggccgcgtttgcggtatcggaaaaagtgtgggtgctcttgatcggcggtatgctcggcattctcatgatgcgtacagtcgcaaaagtattccttgttttaattgataaaatccctgagcttgaaaacacggctttcgtgctgatcgggattatcgccgtgaaaatggcggcgagcgcttttgattatgaaatgccgcacgtggtgttcttcggaatcatcatcgctgcgtttgtggtgacgtttgtcatccattatttcaacaaacaaaagcaggttcaggagcagacggctgcatctaaagaagaataaaaccaaaaaggagggagagttcatttccttccttttttgtaccgataatcaagaagagaaaggaggaagatgatgaggcaggaagaattggtgatccgaaaggctgagcttgaaaacgatgactgggaaacgtttctgatgcagccgctgccggaacgccccggttacgagcgggaaaacgggctggcttttacccgccttgccgtcaggattttaggcactccttatgatgagacggaatattacaatacgcttttcgagctgtcttctcatgaaaacattcatgtattgagcgaaacactggataagaccatcgcgcctgaaacgtttcaggcgctgcagcacattcatacggtcaatcaaaaggagaaagggctttcggtttccaggtttgtcgcgtttctcgacggaggcaggctgcttgccaaacatcccgatccgcttatgcaccgccggctgagaaccgcgtttatgacgcttttggaaacctttgcaagccggcatgaaaacgggctgaatcatcccgatttccggcgtgtgctcctggatgtgtcaaagttttcgctgaaccacctgaatccatggctcgaacaagccgatatagagcgtgagatgccgaaggtggtgtggtatggagacgctgccaaaagccagctctattttctctattatttaatgctggtcggctgtgatgtcctattatttcatccggctggtgaagatctgttcagtgagattgatccggatgaggagctcagctttgtgataaagctccccgcaataggcggccttgagccttttccaaaagaaaaaccggttagaacctccacggcggcctaccggtcaaccaaagaaattgagcatgtgttaaaccatgaagagtcaatgatgtataagccttggcagttcagagagcataccccgcagtccgtgacattaaaaacgacgtatgatgagttatttctcattgcgaaggagcgggcctttatccgtccgcaatttaaagcggacagggagcgggttgccgttccgaacctttttgcgaaagtaatgggggtttccaaagatacgaaagaatattggaacaggctccataccgccgcggactatcaggagacacacatgatccgcagttttccgtttacggaagagctgaaagccaactaccagtatcattacagtcaagtcttaaatgaagaaggaacgattgacgcggaaaggctgaaaagaagcaacatctggcagtacaagcatctcccgtcaggggtgcagaccgccatcgccaatgtgatttctgacatgtgcagaaaccccggaatgaaggctttgccaggggagcaggcaagggatgccgctatttatttgttccgccaggcgacgaacctgcccgcttcgctgctgcaattgattcagacgtttgattacgcccaaaccgttccgaagctgcttttgtatcatacggaacaaaatggcgaattcacgcgttctgatgcggccgctcttttgtttttaaataaattcggcgttgatatcatcttgtataatccgccgggtcatcaggacatcgagcattatatagaagaaagccaatttgatgtccattggctggaggacatggtgtttcggcaggaatataaggagccgtcactcgtaagaaagctgtttagaactattacgcaaaagcagggagagtaaataaacatgacagaaaatcaaaatccgcttattcttgataaaaatgaagagatttctgaacaaaaagcagacgacatcaggctgcagctccgccaagaccctgaggtacagcgcatctcgcagcaaattgatgtgaaaaaccaaatggagctgctcgagtatggaaaagaaccggcagttgaaatctcgaagttctccgatcgcatcttaaatatgatgaaaacaacaagtgtcacagattcaggcacaatgctgacgcagctcggaaaaatcatggatcgttttgacaaaaatgatttcgatgagccaaagggatttctcgctaaaatgttcaaacgcggaaacagcatgattgaaaagatttttcaaaagtaccgcaccctgggcggagaaattgaaaaaatccatgttgaaatttcgaaatacaaagatgaaatggcaaagacgaaccatacgcttgaagagatgtatgagaacaacattaactactacatggagcttgaaaaatatgtcgttgccgggcagatgaagcttgaggaaatgcaggcgcttattccttcttatgaagaaaaagcggcgggcggaaaccagctggcgcaaatgcagctcgatacgctgcgcgacgggcttcaggcgcttgaagaacgtgtgtatgatttagatatggcgcggatggtggcgctgcagacggcaccgcagatccgcctccttcagcgcgggaatacgaagcttatcgggaagatcaattccgctttcgtcattacgattccgattttcaaaaacggcattattcaggctgtcactgtcaaacgccaaaagcttgtggctgattcaatgagcgagctggaccgccgcacgaatgaaatgctgaagcgcaacgctgaaaatatttcaagccaaagcgtggagattgcccgtatggcaggccgtccgagcattgacattgagacaatcgaaacatcttggaatacgattgtcagcggcatgcaggaaacaaagcagattgaggaagagaacagacgcctcagagaagacggagcgaaaaggattcaacagctccaagataatattaaaaacgcagtcttaaagaattaatcagcaccccgcttgcttacggcaagcgggtttttttgcgaaaaaagataatgacaatgtgtaaagacaggtgtaaacttatacggtaatcattttcgatttgaggtgctgcttatgaacaaacaacctgccgtcacaccgcgtaaacttttggcgattgccggaatgggctggctgtttgatgctatggatgtcggaattttatcgtttattatcgccgcgcttcacgctgattggaatttaacacccgatcaaatgaaatggatcggaagcgtcaattcaatcggtatggcagcgggcgcttttgtattcggaatgctggctgacaggatcggccggaaaaaagtgtttatgatcacgctgttattcttttctgtcggaagcggcatatccgctttcgcaacgggattgacggtttttctcatcttgcgttttctgatcggtatggggcttggcggagagctgcccgtcgcttcgacgctcgtgtcagaagcgtctgcccctgaaaagcgggggaggatcatcgtgctgcttgaaagcttttgggccgcgggctggcttcttgcggcggttatttcttactttgtcataccgtcattcgggtggcgggccgcactgctcttaacggcgctggcggcactttatgcgctgattttgcggagaagccttccggaatcaccggcgcatcaggccttatcacagaaaaaaagcatacgcgggcaggcgggaagtgtctgggcgaaaccgtatagccggcagacggtgctgctgtctgtcgtttggttctgtgtcgtcttttcctattacggcatgtttttgtggctgccgagcgtgatgctgatgaaaggctacagcatgattgagagcttcgaatacgtactgatgatgacacttgcccagcttcccggatatttctcagcggcttggctgatcgaaaaagcggggcggaagaccctcttggtcatctatttgctcggaacggcgggcagcgcttatttcttcggtgccgcggattcattgggtatgctgcttgcggccggcatgctgctgtcattcttcaatctcggcgcatggggcgtgctttacgcttatacaccggagcaatatcctgcggcgatccgtgcgaccggttccggcactgcggcggcagtcggcagaatcggcggtattttcggcccgcttctcgtcgggtcgcttgcagcccggaatgtatcgtttacagctatctttgccgtcttttgtgcggccatcctgattgctgtcatcaccatccttattctcggaaaagaaacgaaacagacagagcttgcgcaatgagcacccttttggggtgctttttttagtgaggcgtctgtttgaaagacctatatttttccttaatattccttaattttaggaagaggcaacacctttttttgggacaatatcgcaaaaaaattcttgtatttgtaaaaaaagggtaggaaatcagtttgcagcatatttgatggaaacgttctcaagcctgataaaagctcaatttcccttgtaatttatcatcattaaggaggattagagagtatttagaagcataccagaggaaaataagtcacatggatgtttttaaagtaatgatacaaaataaaagggattatgatgtttgtttgacttattacaaacgtgttacggtattaaagattgcttattatggagggaaaatatgaattcggatgagaaaccaattaagataaaagtcgaaaatgtatctaaggttttcggaaaacagacaaaaaaagccattcagatgctgtccagcggtaaaaataaaaaagagatcctgaaagcgaccggatcaaccgttggtgtcaatcaagcaaactttgatgtatatgatggggagatatttgtcatcatgggtctatcggggagcggtaaatcaactttagtgcggctgttaaaccggcttattgaaccgactgccgggaatatctatattgatggtgacatgataacaaatatgtcaaaagaccagctccgggaagtgcgccggaaaaaaatcagcatggtctttcaaaaatttgcactgtttccgcacagaacgattcttgaaaatacggaatacggtttggagctccaaggcgttgacaaaaaagagcgtgagcaaaaagcgcttgattcgcttaaacttgtcggtcttgaaggctttgaacaccaattccctgatcagctcagcggaggaatgcagcagcgtgtcggccttgcccgcgcattgacgaatgatcctgacattcttctgatggatgaagctttcagtgcgcttgatccgctgatccgtaaagatatgcaggatgagcttttagaccttcatgactctgtcggcaaaacgattatcttcatcacgcatgaccttgatgaagcattgcgtatcggcgacagaatcgtgctgatgaaagacggtaacatcgttcagatcgggacacctgaagaaattctgatgagcccgtccaatgaatacgttgaaaaattcgttgaagacgttgatttatctaaagttctgacagcgggccacatcatgaagcgcgctgaaactgtgcggattgacaaagggcctcgtgtagcgctgcagctgatgaagaacttaggtatttcttccatctacgccgttgataaacaaaaaaagctactcggcgtcattcacgcggcggatgcgaaaaaagcggtcgaatccgacttatcgctgcaggatattttaaatactgaatttacgactgtgcacgaaagcacatacttgacggaaattttcgatgtggtgtctgatgcgaatatcccgatcgccgtcacggacgataaaggccgcatgaaaggcattgtcgtaaaaggcgcattaatcggcgcgctttcaggcaataacgattatataaatgttgaagattctgctgaacaagctcaggattcttctgttcaggaggtgaagtaaatggacagattgcctagaattccgttagcagatatcgttgaccggtttgttgactggcttactatgacgttcggaggtttctttgacggaatctcaaacggattggccgctttcgtaaacgcgattgtgagcgggttgggtttcatcccgtctattttattgactgtgatttttgcagctcttgcttggtggatcagtacgagaggaattgcactctttacgttaatcggattccttgttattgattatttgggctattggtcgccgatgctgcaaacattggcgcttgtcgtaacatctgttttgatttccattattattggggttccgattggcgtgtgggcgtctcagaaagaaacggtccgccgcattgtcacaccgattctcgatttaatgcagaccatgccggccttcgtatacctgctgcctgcgattttcttctttaatatcggcgttgtgccgggcgttgtggcatctgttattttcgcgatgcctccgacgatccgcatgacggttctcggtattaaacaagtcccggctgatctgattgaagcgacggaagcattcggttcaacgacgtctcagcgtctgttcaaggtacagcttccgcttgccacaaaaacaattcttgccggtattaaccaaagcatcatgctggcgttatcaatggtcgttatcgcggccatggtaggtgcgccgggtcttggttctgaagtatacagcgccgtgacacaattgaaaaccggtgtcggagtagaagcgggtattgcgatcgttatcgtcgcgattacgcttgaccgtattacgcaaaacattaaagtgaagaaaaagagcagggggaatgcctgatgcttaagaaaatcatcggtgtcggcgttaccgctgcgctggctctttctttggccgcctgcggttcgcagactgatggtcaagctacggctgcgtcccaggtgaacaaaaccattatcggtattgacccgggttcgggaatcatggccttaacggatgaggccgtgaaggattacggattgaaagactggaacgtcgtgacagcatcaagcgccgccatgaccgcgacattgaagaaatcatatgaccggaagaagccgatcatcgtaacgggctggacgccgcactggatgttctccagatataagctgaagttccttgatgatccgaaaaaaacgtacggaactgccgagcagattcatacgattacaagaaccggcttcagtaaggaacagcccaacgcggtcaaagttctcagccagttcaaatggacgcaggacgatatgggagaagtcatgattgccgttgaagaaggcgaaaagccggccaaagccgctgctgattatgtgaaaaaacataaagatcaagtggctcaatggacaaaaggcgctcataaagtaaaaggtgataaaatcaacctggcttatgtggcgtgggacagtgaaatcgccagtaccaatgtagtcggaaaggtattgcaagacctcggctatgacgtgaagctgacgcaagtggaggcaggcccgatgtggactgcggttgcgacaggcagcgcggatgcgtcattgtctgcttggctaccgaacacccataaagcttatgcgtctaaatataaaggcaaatatgaagatgtaggaacgagtctgacaggcgtcaagatgggtctggtcgttccccagtatatgaaaaacgtcaattcaattgaagatttgaagaagtaatgaagaaaagcagccccgtgccgggctgcttttttttatgtttcaaacgatgcgaggacggcggccgttaatatctcgacgccggtaaagatggcgcttcggtcaaatgtcatatggggatggtgaagccccggctgcagcccgcacccaagaccgagcatcgtcgttttcaagttcggcacctttaacccgtagaagtgaaaatcctcccctccggtcgtcactagaggctcatctacatgttcttctccgagaatgccgcttatcgcagccgccatgatggcttccgcttcttggttccgctcggctgccgggaggctgtgttctttttgcaattcgatttttgcgccgaatgcggcagccgccgcctcgcaggctctttctgtttcagcggtcagtttttccatggcggcattggtttgtgcgcggagatcaaggctgaaggatgcttttcccgggatgatattggaactctctccgcctgcctgaagctttgtcatcttcacggaatgcgggatgccgggatcaagatgaatgaagctcagcttttgcacgagaagggcggcgatttcgatactgttaagaccgagatgcggtcttgcgccgtgggcttcttctccgataatcaggccttcgatatgccggcttgagccatgaagaatggacggcgcgcatcggccgtttgccgtttcctgtacggggcgtacgtgcactccgtataagaagtcaacatcatcaagcactcctttttcaatcattttcagcgctccgccgcctttttcttcagccggctgaaaaataaagcggatggtgcccttcggaagcttccgctggcgctttaaaagcatcatcgtgccgagcgccatggtcatatgtgaatcatgtccgcatgagtggttcgcctgaaagacaccgtccacttcctgccacagcgcgtcaatatccgcccggacagccacgacgggtgaaccttctccgatttcgccgatcaccccggtacaatcatcaaacgtgcgggtccggcagcctgcttctttcagtttttcagtcagatattcagttgtttgatattctttccagcttacttcgggatgggcgtgcaggtggttaaaaatatccataatgacttgtttatcatgttctgtcagtctgttcatgccgtaagtcctccttcaaaagctgtctgtttttttatttttgatattgaaaacaggcaatcagtctgtatataatatagcacatatctgtattttctgaatagtttataaatttcaagcgggatggtgatgttatggctgtgccgaaagccgaacctgtattaaaaaagaagaaatcgtttgtgatgcccgatgcttacgttctgcttttcattgtcgctttactatgtgcgttagcgtcgtacatcgttcccgcgggggaattcgacagggtgacaaagggcagtgtgacgtcggccgtcccgggaagctatcatgctctggagcagtctccggtcagcccgatcgcttttttcaccgcgattcaggaagggatgacaagttccgcaccgattatctttttaatcctctttacagggggcaccattgcgattttggagaaaacgggcgccatcaatggattgatcaataatgtcatcagtacgttccgcacaaaacagctgctgtttattgcgattgtcggcgccttattttcgatcctcggcacaaccggcatcgtcgtcaattccgtaatcggttttatcccgatcggtctgatcgtcgcccgttcgctgaaatgggatgccgtggccggagcggccgtcatttatatcggctgttatgccggatttaacgcaacgatattatctccttcgccgctcgggttatcacaaagcatcgcggagctgccgctgttttctggtatcggccttcggattgccgtctatatttgttttctgctttcttctattttatatatatatcggtatacgagaaggctcaggaaatcaaaagacgccagcctgttggggaacgattggttcccggcggcaggttcagtcccgcaggtttctgagccggaggacaaacaagtctcgttcactgtccggcataagctgattctcgctgttgcggctttgtcgcttgctggttttttgtacggcgcgctcacccttggctggtctgattcagaaatggccgccgtgttcatttttatctcgatcttgtccggcctgattgcgggaatggcggcaaatgatatcgcaaaaacgtttatcacgggctgtcaggggctcgtttacggagcactgatcgtcggaatggcgagaagcatttccgttattttggaacatggaaagctgcttgatacggtagtcaatggactggcgtcactgctgcacggtttcagcccgatggcgggcgcaatcggaatgtatatttccagcgctctgcttcattttttgatctcatcagggtcgggggaggcggtcgtatttattccgatcttggcaccgcttgctgatctgatgggcatcacgagacaggttgcggttgaagcggtcatgcttggagaaggcgtcgtaaactgtgtcaatccgacttccggcgtgctgatggccgtattggctgcaagcggcattccgtacgtaaagtggcttcgttttatggtcccgctggcgctgatctggtttgtgatcggccttgtgtttatctgcataggcgtcctgatcaaatggggtccttactaaacattttgtcaatgatatttcggtttatcattatgaatcggcaagatataatgaagttgtaagccattcataaaagtacgggaggaagtcatcaatcagcgtaggaacagactttcaaacgtgaatggaaagagtgagagtgtgagagagaaagaacgaatgatttggtcagaagtcggaatgcttatgggcacactgtctttgcttgacatcatagtacgcggacttgtcctgaactgtccgtttagggaatgggccggaagcttggcggttttcttcattataatcgtttattattgcatcagagcagctgcatcggggattttgctgccggctattcattctgaagcagcattgaaaaaacaaatcagacggcaaatgggagaaacgcttgccgttgccgttatcattacgctgatcaccatgtatgaccaaggaatcccgcatcactttacaggatggctgaaattgattgcattatttctcgtatgcagcatcttcatatttctggtccgttatgttgcagtaaggctgatttatagaagatctcgcaaaaaaagctgacaaatgagccctgcttggtttcaagcagggacttgctttatatgttggccgattttgaccgtgcttttgcaatgtatgtatgagcggctaaatcatgtacactctgtgagcgatttttaaagagaaataaaaagtataacagcgggctcgcgcaatacacgaagatcgtaaaatagcggataaacgcctgcttaaaagaaatgttcccgcgggacttttcatcggcgacacgcagcctgaaaatgaacagtccgatcgttcctttcatttttgtaagcggcatcagcatcggatacagaataatcatcacaaattcagagatcagcacggcccacaaggcttcatcggtcagtttcgcgatatagaggatgactgatacaatgataatcacatctaacaggacagccggaatgcgataatagaactttccggcatcgggaagcggttcggatgactggacatccggtgatttcctgagaactgcggtgccggccgccatatcgtgaactgcctgcgctttttctgtaaagtgcaccgtaataaacggcagaacagagagaaagtgaagaagggaaacaaaaaatctgccgacagcctgcccgaatgaaattctgctcccatcatgcgcttttaccaccttcagtttaaagaggtaagcgccgatcgttccttcaagcggagtaagcggcatcaaaatatagcaaagcacaatcaagccggtaaaaatgaagaaaaaagaagtgctcagcggtctcccggcatataaggtgattggcacaagcagaatgaataggtacatgagcagaaggtcaaccaaaaaagccgccatccgttcacctatatttgcataattcatgattcattattctcctttcgtacagtaaaaagacaacaaatcacattttatagtcagatttccttttttagaataggtatttattccttattttctcttaaatgacattacaactattcatttattcctttcagttggaaagaataaaaaaataaaatttttctcttgcaaaagtttgtgaagtattgcacaatataaatgtgaaatacttcacaatataaaaacagacaccacgaaacactggaggatgagcatacatgatgaacgaacgagtgaacaaagtagcattaatcggagcaggttttgttggaagcagttatgcatttgcgctaattaaccaagggatcacggatgagcttgtgatcattgatgtaaataaagaaaaagccatgggagatgtcatggatttaaaccacggtaaggcatttgcgcctcatccggtaaaaacgtcttacggcacatatgaggattgcgaggatgccgatattgtgtgcatttgtgccggagccaaccaaaaaccgggcgaaacgagacttgagctggtcgaaaaaaacctcgccattttcaaaagcattgtcggtgaagtcatggcaagcggatttgacggcatcttcctcgttgccacaaacccggtcgatattcttacttatgcgacgtggaaattcagcggcctgccgaaagaacgcgtcatcggcagcggtacgacacttgattctgcgagattccgttatatgctgagtgaatacttcggcgccgccccgcaaaacgtacacgcccacattatcggcgagcacggagataccgagcttcctgtatggagccacgccaatatcggcggagtgccggtgcagcaattactggagaaaaatgcagcttacaagcaggacgagctggatcagatcgttgaagatgtgaaaaacgcggcctaccatattattgagaaaaaaggcgcgacatattacggagtggcgatgagcctcgcccgcatcacaaaagcgattttgcgtaatgaaaacagcattctaaccgtcagcacatatttggacgggcaatacggagtcaacgacgtctttatcggcattccggccatcgtcaatcggaacggcatcgccggtgtggcggaacttgagctgaatgaaacagaacaggctcaattcagccgcagcgcaaacgtgctgaaagatattctcgctccgcattttgcagagtaaacacaaaaaagcagtacatgacaaacgccatgtactgctttttttaattcgcttttttcgccatttcctgagaggttttcactctcgcttttcccatgaacaaaacggtaacggctgcaatgacgatcggcaccagagcaagagtaaatacatatgtgatgctttgagacattgcgtcaataattttatccagaatctgcggcggaatatgagcgcgcgtgccggcctggaagatttcctgaggatttccgatgttctgcatcgcgccgcccgctcctttcatgccgctgaaagaatctgtaagcttgttggtaaatacattcgtctggatggttccgaaaatcgtcacaccgagcgtcatgccgaatgatcttaagaacgagtttgttgagttggcgcttccgcggtagcgcggctcaaggtcattcatggacgctgccggcagcaatgagaagttgaagccgacgccgaatccggagatcagcatgaatactgtcagcatcgtacgcgccgtatccggagtcatattcgaaagcagcagcattccgataaagaaagcgaccacggaaatcagcattaaattacggaaccgcactttcgtttggaaaatcccgccgatcatacttccgataacagaaccgatcatcatcggcgtcaaaataaagcccgcgcttgtcgcggtgcttccgtacacagcctgaacgaaaatcgggataaacaccgccaaaatcacaaatgtggctccgtaaaggaaagccaaaatctgagcggtggcaaataaacggtttttaaacatccaaaatgaaataatcggttcttccgcttttctttccacaataaaaaaggcgataaagaacacggcgaacacagcgaacagaccgatgatctgaacagagttccaatcatacgtttttccgccgagctcaagagcgaacatcagaccgacaatggaaaccaccagcgtaatcgcaccggcccagtcgattttctgcttcttgtgctcaagtgattctttataataacgaagaatgaagaacagtgataaaatgccgatcggcacgttgatgtaaaacacccagtgccagctgatggagtcggtaatgagcgcgcctaaaagcggtccgagaacactggacagaccgaaaacggcaccgaacatacccgacatttttccgcgtttttccggcggaaataaatcaaaaataatcgtgaaggcgatcggcatcagcgcgcctccgccgattccctgaatgacgcggtaaataatgagctgatccattgtttgggcgattccgcataatgcagatccgattaagaaaagaataagaccgaataaaaagaaacgtttccgtccgtacatatcggacagttttccgtaaatcggcataccggccataacggctaccatgtatgatgccgtcacccacgcgaacttatcgaaacttccgaggtccgccacgatatttcccatcgcagtggcaacgattgtattatccatagccgacattaaaatgcccagcaaaagaccgatgacgacaaactttgtcgaggcgtccttcgcggctgtttgttccatgctttttcctcctatacttacttttgatcattaaatttgctatgatcatattagatttgccgaaaattatcttgatcgtcaagataaattgattttatagggaggcctgtcagttgtcaacaagaaataccagaagcgagacggaggaaaccgccatacagttattccggaagatggccacaaggacgatcctttttcatcaggcggccgctcaatctctcggtctgtttccgaccgatttgaaatcagctgatattttaaatgaagcaggcccgatgaccgcgggtgagcttgggaaaaaaaccggcctcagcacaggctcggtaacggcgctcattgaccggcttgaaaaagcgggatatgtcatgaggaaaaaagatcccgaagacaaacggcgggtgatcattgtgccgctgacagcgggaaaagcgaatgtgaagcaattgttcagctccttatcccagtccacggtcagcctttgccggcaatataaagaagaagaactgcatctgatattcgattttctcaaaaaagtgacggacattatggaagatgaacttgagaaattaaaataatatatcatagcccggcccattcatgaataatttgtacaagttgcatgaatgaggaggaagccaatgaacatctttttaagctacatcgttctcgggctgtcattgtcagcacctgtcggcccggtcaatgcggcgcaaattgacaaaggcatcaaaaacggcttttggcatgcatggattttcggtcttggcgccatggcggcagacgggctgtatatgattctgatttatttcgggctgtctcaatttttgacggctccatttgttaaaacgtttttgtggctcttcggttttttcgtgcttacctatacgggagtcgagacgttaaaaaatataagggaagccatgaatgtcagaagcggaaaaggaaaaccggcattttacaaaacattcggcgcggggttttttatttctctttccaatccgctgagcattttattttggctcggcatttacggcagcattctcgccaaaaccgctgaatccttcgatgcgaaccagcttttgatttacagctccgggattcttctcggcattttgatctgggatttctgtatggcgatcgccgcgagcactttcagaaatctccttcatgaaaaagcgcttcgctggctgacgggagcggcaggtgtgtccttgatcgtttttgggttttatttcggatggcaggggattcagatgctcatctcataaagagaagaacagtcactcatcgcctatctccatcataacgtatcatgacgatactggaggtgggcagatggcaagcgtgctgtacacaaaaagttgccttgaggaaaatttattgaatctgccaaattggcagaggatcgcttttgagctactatcagaaaaggtaggcgatgaagcggacacatttccgtgcattcccggccgtcagggatttctgacagatcagctccggatatccttcgcgggtgaccctcgtgatcgggaaaccccggaggaagtgggactgctgctgtccgagtacggaaagatctcaagggataccggaagatacgcgtcgctgcttgtgatttttgatacgccggaggatttagccgagcactgttccattgaggagtatgaagagctgttctggtctttcttaaagcggctgagcggctgcgacccgaaagactggccggaagacatgccggaagatcctgaacattataaatgggagttctgctttgacggcgagccgtattttattctgtgcgcaacgcctgcgcatgaagcgagacaaagcagaagctttccgttttttatgctggcgtttcagccaagatgggttttcgaaggattaaacgattcaaccgtgttcggacgcaatatgagccggctgatcagaaaacgattagaagcatatgacgaagcccctcttcatccccgattggggtggtacggaggaaaagacaatttagaatggaagcaatatttcctccgtgatgatgagacgcaagtgtcaaagtgtcccttttcttacttgaaaagattgtttaaaccgacgaaataagcaatgatccggcagggctgtgtccctgctttttttgtacgatccatgtcacgattgcaatgatggcgagaaaacaaaggctgaccagaaaaccgggccggcttgatttttcaaacagcgtgccggagacggccgcgatgatcagcaagagggcgataaaaatctgtgtggttcccatctttgtcggttcggtcagtttcttgcttgagaataaaatgaacagccacgtataaagaagcatcagacccgccgcggttgtcatgtgttcatatatatttttcggcagcaccaatgacagtatgatggagacgataagcccggcaaatgtcaatccgagcgcaggccagcagatctttttgttttcttttaatctgaagcatttcggcgcgtctccgtcatcagccattgtacagagcaatgtcgtcacggcaaacagcgaggcgacgagcgtagaaaatcccgcaataataaaaatcccgttaaaaatatcaagaatgacatctaaatgaaagcccttcagcgacgaaataaacgggctgtcctgttcggtgaatttggcgagcgggatcaacagcagcgccaggccgagagaaataacgtaaatcaccgcaagaacgatgagcatcagtctgcctgattttgaagcttcctccggctttttcagatgtacggtcatcagccccaagacttcaattcctccgaaagcgtaaaacgcataaatcagccccgtccataaccccatcgctccgtgcgggaacaaatcctttgtatcattcggcacctgcacatccgacttgtgtgaaaatataccgcacagcgccaagacggcgatgacgataaacataaaaatcgccgccgtttttacaacagcgagcacatgctccgttttttgaaaaacggacaaccccgtaaaaataatcaaaagaccgagcaccgcatagatggaggcgaagatccacagcggcacattcggaaaccaatgcttcgtaaacagcgagatcgctgtcagctggctccctgtgatcagcatttcggacgaccagtacacccacccgttgctgaagcctgcccaagagccgaaagcctttctcgcataagcgcaaaaagaccccttttcgggctgcttagccgaaagcttcgcgagctgctcaaagacaaaataggtgccgagtccggcaatcagaaatgagatcagcgcggaatatccgcttttgacaatagcgatactggacccgagaaagaagcccgtcccgattgtgcagccgacgccgattaaggagagctgccaccaagcgagatttcctttaggctggtcctgtgatttacccatgaaattcaacccctttatcaaagcttagattgcggccggcagaacgggaatatacatccaattaattgctttacatgaaacaaacggccggggttcataatagaagaaaaaaggagcagtctgatgccacagcaatttatcgtaccgccgaaaaaagggctcggcctgaaggttcacaaagggcagattataaaagtagtcgatgtggaaggacagcaggtggctgactttacggcctatcatgccaaggacttttatgagcatcttgatcagggcgcgacgattgatgccaaccagtccatcaatgtgaaaacgggcgatcatatttattctaatttatacaagccgatgctgacgctgattgaagatacagtcggcaagcatgacctgctgctccccgcctgccgcccggatatgaacaggcttttatacggaaagcataaagacgagctccaggatacgtgctatgacaatatgagcggggcgcttgagcaattcggggtgccgcggccgcatatgcattatcctttcgccattttcatgaacacggtgcttgatgagaaagggaacttgtcagtcgaaacgcccctgtccgacgcaggcgattatgtacggctccgtgcggaaatggatcttgtcgtcgcgttttcctcctgcccgattgaaaaaggaaaatgcaacggcgacagcatcactgcgctgcgggtggaaatcagctgatcccggtgtatttgattcacttaaaatctgcacctgtgctatatttaacagagtcgtacatagtggcatgattcatttccagcatgaacgggaaatgaatcaaaagaaacaatgcaggaggagtgattgggatgagcatccagaaacaaattatgaatgatctccatgtaaagccctcaattgatccgaaacaagaaattgaggacagagtgaactttctgaaacaatatttgaaaaaaacaggtgccaaaggctttgtgctcggcatcagcgggggccaggattccacgcttgcgggacgcctcgcccaaatggcggctgagagcatcagagaggaaggcggaaacgcggaatttatcgccgtacgtcttccgcacggcacacagcaggatgaggatgacgctcaaatggcgctcaaattcattaagcctgataaatcatggacgtatgatattaagcccgctgtcagcgcgttcgccgatcagtacaaaaaagaaaccggcgatcagctgtctgactttaacaaaggaaatgtaaaagcaagaatgagaatgatcgctcaatatgccgtcggcggacaagaggggctgcttgtcatcggaactgaccatgcggctgaggctgtgaccggcttcttcacgaaatacggtgatggcggagctgatctgctgccgcttacgggcctgacgaaacgccagggcagacgtttattagaagagctcggcgcgccggaacgcctgtatttaaaattaccgacggctgatctgctcgatgacaaaccgcagcagactgacgagaccgaacttggcatcacatacaatgacattgatgactatttagaaggcaaggacgtttcttctgaagtaattgaggcgctggaaaaacgctacctcagttcggagcataagcgccaggtgcctgcatcgatgtttgatgattggtggaaatagaaataaaaaacctcccttttgaaagggaggtttttatttcttatgaaagcagtgtttcatctcattcagagattctttaatatgcacttcagcatgacgaccgaagtattcgagtgacacgaatccgccgtattgcctgttcatcagttcattcagcaagggttcctgctgtaaatcaccttgcagcacaggcaccggcttgctgagataccagttgtcaaagttccaatgatagttttttaagtgaatatggctgacggtatgatacagtttttccaaagcggtcatttggtcaatgtgattgacgtgaaggttggagccgtcaaaaatgatgcggacccgcggatgtccgacatcctctaaaaatgccagcgccgcctccggtgtatccgcgtacgtatcgtaatgaatctcaagcccgatatcgacttcataactgtcagcgagccgtgccgcctcctgaaattgatcaaccgcacgctcccacttttccggtgacgtccggtgcgaagccagattgcccgcaaagactctgatcaaggggctgtgaagctgccgtgccgcgcttaatgctctttgaacatcttttaatgcctgcctttcatcctgagagacgaagtcagtgtacaagctgacagccggcacctcgatgccctcctcctgaagctgctgatcgagcctgtcgagcgggccgatttccttaatatattgtttgatgtggccgtaccacagttcgatgccgtcaaaggagtgctccttcgcgaaagaaatgacgtcgagaatatgcttttttttagaccccgtcgtgcaaaagctcagtttcatcggtaatcctcccgttaactgtctatcatatgtgtacttttccccgggtacgatacggataaacagatgaaaagggtaaacactttttttatgagggaggttcacctgcatcattcgcacataaatagtttagtgcttttttgcgtcaaagtattaaataattgcccgaagtgttgtacaatggatgtcattcgagtaagggggagaagccattgaaaaatgaaacggagctgacggacttcagtcccatccgcaataaaccgactcgcgctcgttatgtgatactggttcttttgttttttatcactgcgattaattatatagaccgtgccagtgtatccatcgccgccccgtccattcagacatcgctgcatataagccccgcgctcttgggcgtcgtattttccgcgttcagctggacctatacgggaatgcagattccgggcggactcattctggacaaattcgggtcaaaacggacgtacggaatttcattatttgtctggtcggttttcacgggagtacaggcttttgcagccagtttcggatttttattcggctgccgcctgattatcgggctggctgaatcgcctgcgtttcccgcaaacaaccggattgtcacgacgtggtttccaaggcgtgaacgcgcctttgcgacgggtgtttatacggcgggggaatatgtcgggctcgcattcgccacaccggtattattctggattttgacggcatttgactggcgcgccgtctttatttcttcgggggcgctcgggcttattttctccattttctggtttaagatgtatcaggagccgaaccggtatcggaaagtgaatcgggaggagcttgattatattaaagaaggaggcggactgacagaggtgtctgaatcagccggcaggatcacgtgggcggatttcgtccagcttcttaagtaccgcaagcttgtcggcttgtatatcggccaattcgccgtagcctccacgctgttcttctttttgacatggtttccgacttatctggcggaggcaaagcatatggccttcttaaaagtcggcttcgccgcatcaatcccgtatatcgctgccttcttcggcgtattgttcggcggattttggtctgacggcatgatgaaacggggcgtgtcggtgaacgttgcccggaaaacgcctgtcatcctcggtcttctgctgacaggcaccatcgttctcgcgaattttacggattcttctcctgcggttttgacgattctatccattgcttctttcgcgcagggcatgtccaatatatcctggacaatgctgagtgaggtggcgccgagcgagacaatcggattggcagggggcgtgtttaactttttcgccaatatggccggtatcatcacaccgcttatcatcgggtttatcgtctccgcgaccggttcatataacggagcgattctgtttgtcggcgctgtcgcttttatcggggcgttttcttatattttcattgtcggaaaggtcgaacgcattacgctccgatagaaagaaaaactcatctcttcttgttgaggatgggttttctttcattgattatctctatatttcaatattgaattatcatataataaacataactttttcattccttaggaggatttcgccgaagatgaacgcaaaacgtgccattcccgtaagagaaagaaatatcgtactgatcggattcatgggtgtcggaaagacaacaatcggccagctggtcgctaaaaaattatacagagatttcattgatattgatctgcagattgagaaagatttcaatatgtccattcccgaaatgtttgagaaaaagggtgaagcctttttcagacagactgaaaaggattatatattagatatttgccgcaatacgaaattcaagatcgtgtcgcttgggggcggttcgtttaaacaagaggaaatcaggcaatgctgccttgaaaactgtctcgtgctccatcttgatttgtcatgggagaattggaagcagcgggctgacctgctgattgaaagccgtccggttctgcataaccgttccatggaggaaatgcagcagctctttaacgagcgccaaagcatctatgataaacataattcaaaagtcgcgacggataatctggaacctgaagaaattgccgattatatcgtcgaaacgttaaaaatcggctgggacctgtatcagccgatgtaaaaagagccgtgacgctgtgagcgcacggccgtttttctattttaaacaaacgtttgataaaaagtgaatgcgcccgccgattatttataaaaatgtttagaaaataagtgtgaaatcgtgttaagatagagtcagaaaattaaatcttataaaacaaaggggaataatcggatatgcaattatacgacttgccgcttgaccaactgcaaacctataaaccaaataaaaccgcacctcatgactttgcggatttttgggcatcatcattacatgagcttgcaaaggaaaaggcaaagcctgaattgacgcctgaaagctatccggctgacggcgttaaagtattccggctgaaataccggagcttcggcaaggcggaaattgagggatggtacgccgttcccgaccgaaaaggaccgcatccggccatcgtgaaatatcacggctacaacgcgagctatgacggggacatccatgatatcgtgaattgggcgctgcacggatatgctgcgttcggcatgcttgtccgcggccagcacagcagcacagatacaagcgtctcaccgcacggacacgttcccggctggatgacgaaaggaattttagataaagatacatattattaccgcggagtgtacttggacgccgtacgggctctggaagtcatcagcggctttgacgaagtcgatgaaacgagaatcgccgttatcggcgggagtcagggaggcgggctttcaatcgccgcggcggcactatccgacattccgagagcggttgcagccgattatccttacttaagcaattttgagcgggcgattgatgtcgctcttgatgagccgtatcttgagattaactcctttttcagaaaaaacggcagcccggagacagagaagaccgcgatgaatacactggcctattttgatatcatgaatctggcagaccgcgtaaaggctccggttctcatgtccatcggactgattgaccgcgtgactccgccgtctacggtatttgccgcttacaatcatttagaaacagaaaaagaattgaaggtttaccggtatttcggccatgagtacataccttctttccatacggaaaagctggcctttctgaaagcgcatctgaaaggctgataaaagcgaaaagcccaagttttacatttgggcttttttcatgaatgatgacggaaaaggacggatacaaatgaaacaaaggatcatcgaagaattaaaacgaattgaggcacagcacgacgttaaggtgctttacgccgtagaatcgggaagccgcgcatggggatttccgtcaagcgacagcgactacgatgtacggtttctctatgtgccgaaaaaagaatggtacttttccattgaaccgcatagggatgtcatagaagagccgatccatgacatgcttgacatcagcggctgggaattgagaaaagcgctgcggctctttaaaaaatcaaatccgcctcttttggaatggctctcttctgagatgatctattacgaagctttctcggcggctgaaaagctccgaaaactgaaaacccgcgccttctcgcccgaagccggcatccatcattatctcaatatggcaaaacggaatgaaaaaacggaactgcggggcggtgaagtgaagattaaaaagtacttttatgtcctgcggcctctcctcgcctgcaggtggattgaaacgttcagctccgtgcctccgatgtcttttcccgtactggcggatgccctattgacggatgaatcgctcatttctgaaatcaattctttgcttacaaggaaaaaaagcggtcaggaactggctccggaacccaaaaatacgatcattcacgcgtttatagaagaggaaatagaacgcatcgggctatatgccaaaacgataaaaacgccgaaatccgatataacggaagaattgaatcagctattgattcagaccgtcgaagaggcgtgggagcaaaaagacggaaattgacgatttctgtcatttccgtccgccttttttcggcataaaccgcctgctctctaagaagctgattgtggtaaaaccacaaaaatttatcagaatctttgtatttttagaatattgtgagaggatgttttgtccatttacaatagactcatacaaatacttcttagattgcggggtgttaaggttggaagtgattacaagagattttttcttatttttgtccaagagcagctttctcaataagatggcgagaaactggggaagccgcgtggcagccggcaaaatcatcggaggaatggatttccgcagttctatcccgacaatccgacatttgaacagccaggggctgtctgttactgtcgatcatttaggggaatttgtcaacagcggtgatgttgcaaaggagcgcaccgaggagtgcatgcagaccatcgctttaatcgctgatgaacagctgaattcccaagtgtcattaaaaatgacgtctttaggtcttgatatagatctcgatctcgtctatgaaaatatgacgaaaatcctccagacagcggaaaaacataaagtcatggtgacgattgacatggaggatgaaacgagatgccagaaaacgctggatatctttaaagacttccgaagccggtatgaatacgtaagcaccgtggtacaggcttatctgtacagaacggagaaggatcttgatgaccttggcccgctgaacccgtttctgcgccttgtcaaaggagcctataaagaatcggaaaaggtggcctatcctgaaaaaagcgacgtagatgaaaattataaaaaactcatccgcaaacagcttttaaaaggacattatacggcaattgccacgcatgacgacaagatgatcgattttacaaagcagcttgtcaaagagcacggcattccgaacgaccgctttgagtttcagatgctgtacggcatgcgctcgcaaacccagctcagccttgtggaagaaggatacaacatgagagtctacctgccttacggcgatgactggtacggctatttcatgagacggctcgctgaacgcccctcaaacatcgcattcgcctttaaaggaatgacaaagaagtaaaaaaagggagagatgacaatgactacaccttataaacacgaaccattcacgaatttccaagatcaatcaaacgttgaagaattcaagaaagcgcttgcgactgtaaacgaatatctgggaaaagattatccgctcgtcatcaacggtgaaaaagtagagacggaagcaaaaatcgtatccattaaccctgcagacaaagaagaagtcgtcggaaaagtgtcaaaggcatctcaggagcatgccgagcaggcaatcgaagcagccgctaaagcgtttgaggaatggagatacacatcccctgaggaaagagcggccgttctgttccgcgcggctgccaaagtccgccgcagaaagcacgaattctccgccctgctcgtcaaggaagcgggaaagccttggaacgaagctgatgcggatacggcggaagccatcgactttatggaatactacgcgcgccagatggttgaattggcaaaaggcaagccggtcaacagccgcgaaggcgaaaagaaccaatatgtctacacaccgacaggcgtaacggtcgtcattccgccatggaacttcctctttgcaattatggcgggaacgacagtggcaccgattgtaacgggcaacacggtcgttcttaaaccggcaagcgcgacacctgtcatcgcggcaaaattcgtagaagtgcttgaagaatcaggccttccgaagggcgttgtcaactttgtgccgggaagcggagcggaagtgggagactatctcgtcgatcacccgaaaacaagcatcattacgtttacgggatcacgtgaagtcggtacgagaattttcgaacgcgcggcaaaagtgcagccggggcagcagcatctgaaacgcgtcattgctgaaatgggcggtaaagatacggttgttgttgacgaggatgcggacattgaattggcggcacaatccattttcacatcagcattcggctttgcgggacaaaaatgttctgccggatcccgtgcggttgtgcatgaaaaagtatacgatgccgttcttgagcgtgtcatcgaaatcactgaatcaaaagtgacggcaagccctgacagcgctgacgtgtatatgggccctgtcatcgaccaaggctcttacgacaaaatcatgagctacattgaaatcggaaaagaagaaggccgtttagtcagcggcggcaccggagatgattcaaaaggctacttcatcaagccgacgatcttcgctgaccttgatccgaaagccagactcatgcaggaagagattttcggtccggtcgtcgcgttttctaaagtgtcaaactttgatgaagcgctggaagtggcaaacaataccgaatatggtttgacaggagcggttatcacaaacaaccgcaaacatattgaacgggcgaaacaggagttccatgtcggcaacctgtacttcaaccgcaattgtacgggagcgattgtcggctaccatccgttcggaggcttcaaaatgtccggaacggattcaaaagcgggcggcccggattacttggcccttcacatgcaggcgaaaacaatcagtgaaatgttttaagcgggactgaatgggcacctcctcgcggggggtgtccatttcaccataaacatataaaacggaggaggaaatgccatagcaaacattcagttgattatttccatttgtatttatatggcgggaatgctgtttatcggttattacgcctacagacggacgtcaaatctgacggattatatgctcggggggcgttctttaggccctgccgtgacagcgctcagcgcgggagcggcggatatgagcggatggctcttaatggggcttccgggcgccatgttttcaacggggctaagcggcgcttggattgtcatcggacttgtgctcggagcatgggcgaactggcttttcgtggcaccgagactgagaacgtataccgaaaaagcgggaaattccattaccattccgggtttccttgaaaatcgtttcggcgatcacacgaagcttctcaggctgttttcgggtcttgtcattctcgtttttttcacattttacgtatcatccggcatggtatccggaggcgtcttattcaaaagcattttaggattgaattaccacacggggctgtgggtcgtgacaggcgtcgttgtcgcctacaccttgttcggaggctttttggcggtaagctggacggactttgtccaagggatcattatgtttgcggcgcttattctcgtgccgattgtgacaatttttcatacgggcggcccgggagaaaccgttgccgatatccgttcagtcaacccggaactgtttaatatgttcaaaggaacgaccgttctaggcattatttctttatttgcgtgggggctcggctatttcggtcagccgcatattattgtgcgctttatggcgatcacatctgtgaaagagatcaaacgcgccagacggatcggaatgggatggatgattttatctgcactcggcgctctgtttacggggctcgcgggaatcgcgtattaccatcagcgcggattgaagctggctgatccggaaaccatttttattcagctcggcaatattctgttccacccgattattacgggatttctcatttctgcgattttggctgccattatgagtacgatttcgtctcagctgctcgttacgtccagttctttagtggaagacttgtataaatccatgttcaggcgttcggcttctgataaggaactcgtatttctggggagaatggcagtacttgcggtgtccatcatcgcattggtgctcgcatgggagaaaaacaacacgatacttggccttgtcagctatgcatgggcgggattcggcgcttcattcgggccggtcgtactgctcagtttattttggaaacggatgacgaaatggggggcactcgccggcatgattgcgggagcgattaccgtaatcatttgggcgaatgccggtctttcaggctttttgtacgaaatcattccgggctttgctgtaagccttgctgctgtatttgtcgtcagcttattgacacaggctccgtcaaaagatgtcacagatcagtttcatgagtaccgtgatacactttctcaataaaagcaaagaacgagaggaagaagggaccgccctttttcctcttttcatgatacaggcctccggataatactattttgggaatatatgaatttttttctatacaaaaagtcaccccgcagagtatgataaagataaaaagagcataggagaaataggtatggaagagcttttagagagagttttttcatttacggacattgataaattaattgatttcatcagttatgaattgcagaagcccgtcattctggaaagcgcggatttctttttgcttgcctataattcttattacattaatcacttcgactccgccaaccagcagacgatcttctcaaaaaaatgccccgtgcagatttttgaaaggtttctgaaggacggggtaatcgaaaaactgaaaaccgttcctgaaccgttccgtgttgaaaaaatagacagtatcggcctgaatcagagagtggttgtaagcgctaaacataaaggggaagtgatgggttacatctggattcaggagctcgaccgcaacctgacggacgaagagctcaactttttatatgaaacatcatttcatgtcgggaaaatcatccataaaacgaaccgggtgaaacaggaaaaggaagagagagcggaagaccttgtgaagcgggcgatttttcagcaattctcctctgaaaaggagttcaggcgggaggcagaaaagatgaacgccgtgctgccgtcggtcttttcagtagtcgtcctccatgccgcaaatggagatggggaggcagtcgaagatgtgaaggaaaatatcaaatcgtacttgaatttgcgagataaagtgagtcatgttttaaccatcgattccaatattgtcatcgtcgtcgcaagcttctcgcaaaaaagctccggcacttcggcagcatctgaattcatccacaaactgctgactcattttcactttcagaagatccccactccaatttatatcggaatcggcaatgaatacagcagcatcctgaagctcggcaaaagttatatagaagcccttgaagttataaaggctgccgaaattaccgggaaccaggaaaatatcccgtatgaatacagtaagctcgggatttaccgttatcttgaaagcatcgaagaaaaaaacgcctcactggaatatgtaaactatgatttagctttattaaaagccaaagacagagaaagcagtaccgaactgctgaaaacattagaaatctatctcctcaataactgcaaaacaaaaccagccgcagaacagctttttattcatcaaaacacattgaactaccgtatcaaacagattcttgacatgacttcaattgatttaaacgacttcagaacaaggtgtcagctgtatctcgatattatgctgatgaaaaagaaatagaaaagaaaccagtcgccgtactggtttcagctttaatccctcccgcctgtcaactctcactgaaccgcgcttgtgaatctctccttttccgtgatgagaaatgaataaacaccgctccccgatgtatgttatactttttattgatattgattctcaattaaaactttttaagtatagatataaacgggaggcagaataatggcggaaaatcatgaggtgtatgacgtcacgattataggcggaggcccggtcggcctgtttgcggctttttattgcgggatgcgcgagctgaaaacgaaggtgatcgagtttttgccgcggctcggagggaaagtgtctatgtttttccctgaaaaaatcatccgtgacatcggcggaataccggggatcaccggggaacagctgattaagcagttgaaggagcaggcggcgacatttgagccggatatcgtgttgaatcagcgggtgaccggatttgaacggctggaggacggaaccattgtgctggaaagtgccgaaggggaaaagcactatacacgcaccgtgatcttggcggtcggcatggggacgctggaggtcaatgaacttaacagtgcggatgcgagccgatattcagggaagaaccttcattataaagtggagaagctggatgcgtttcaaggtaagcatgtcgtgatttccggagggggagataccgcggttgactgggcgaatgagctggaaccgattgcggcgtctgttaccgttttgcaccgccgtgaggagttcggcggcttggaaagcagcgtcgcgaaaatgaagcggtcttccgtgcgggtgcttgcgccgtatcgtttgaagcatattaacggcacaggagaacggatcgaaagcgtcaccgtttgccaaactgagtccggcctttctgaagacatcaagcttgatgagctcattatcaaccacgggtttaaaattgatctcggtgcgatgaaggattgggggcttgagattgaagaaggcagaattaaagctgacagacatatgcggacgaaccttccgggggtgtttgttgccggtgacgctgcgtattatgaaagcaaactcagattgatagccggcggtttcactgaggggccgaccgccgtcaacagcgccaaagcatatttggacccgcaggcggatcatatggcgatgtattcaactcatcataaaaaattggtgacacaataaaaagggactgacctccgctgttgggccgggggtcagataaagcgcatcagctgtgaaggagcacttctttcatttcatttcgtataaacgcaaataattgttcctgatttttcacggcggtaaatccgtaaccggcgggcacgtcttcgcccatgcagacgacaggagggcggtttgccgacgggttcggtgatatgccgatctcttttcccgcgctgatcaaatgctgagcggcttctttgtccggacagataatcatttgcagaggggactcactgatcgtgcgttcgatcatggaagtgaaccgctcatctgcaatatgttcatgggtgacataaaacgggcatgattctgagtctggcatgtttactgccgcttgacggctccttacaatgagtgaatgcggagaatcactttgatattctgataggaggaagccccgtttttcaagttccttctgtgccgcttcagtcgctgcattcaggtttgcggtcacccggcggatgtcgatttggttgaaagccaatgtgtcaaagaattcacagacggcaaggcgtgatgtgaaaaagatatgttcaaaggtgccgatctgttttaggatggtttcgttgaccggcatttttttaatgatccgcttcggccattcgataacatcggcgccatactcccgcagcttgtctgtcaatgtatgttcagcatcgccatgggtgaccaccatgatatgccggccgatgaacggtttgctttcaaaccagctatgtgtttgaaaattcacgatatctccgatgacaataatggcagggttggtgattttacggctttgtactttttcatggatatcgtgaagcgttccttttatgctccgctgccgcccccatgttccccattgaatgacgagtacagggacggaaggggattttccgtactccataagcttccggcatataaatgacagatttttaacgcccatgtaaaacacaagcgtttgaacgcttctggcaagcccttcccagtcaagattcggcctgccttgtaatgatttatcatgagcggtaatcatggcgaaggacgaagcgaaatcacgatgggtgacagggactcccgcatacatcggcgctgcgattcccgaggtgatgccgggcaccatttcgtagcggatgccgtgctgatgaagcgcctctgcttcttcgccgactctgccgaacacacttggatctccgcctttcaagcggactacggtgaagccctccgccgctttttcaatcagcagggcattgatctccgactgtttcataaaatggcggtcgggcagctttccgcaatagatgaaccggcattccggtgaggcatattcaagaaactttgggtttgcgagccggtcatacaaaatgatctccgctttctccagagcctgttttccttttacggtgatcagccccgggtctccgggtcctgcaccgacaaaatatacgattccgtttttcatgatggcttcatcccttcacaatttaaaaaatgaaggaccacttgaaaaagtgatccggttctttgatcaatacaggaggtatacattctctccttcgatcaatgtatcgtatgttttgatacagccatgatccggctcttggacttttccgtcttctaaggagattttccagtcatgcatcgggcagaaaacgtattctccgctgatgatgccttcagccaggacgccgcctttatgaggacagcggttttccacggctcggacgcttccgtcggaaagcttaaatacggcaagctctttatcttctacatatacggtttttcctaatttctcaggtaattcgtttaatctgcctatgcaaacctttgtcatatctttattaaccatgtccgttccccctcactgtttgttctgtctttatgaagtcgtgacgacattttcgaataaatctttagaagcttttttatcattaaggaagtattgccacggatctttatggacagagagtgtctcattcattctgtcattgagctcctgccgtttttccggatcgtttaacacggattggacatgagataaaccgacgcgctccagccatgcggatgtacgctccagatagtttgccgtttctctgtagtactgaaggtaagcaccagcgtattctaagacttcttcatttgttttcactttcatcagcaaatcaccggcgcgcaaatgagttccgccgttcccgccgacataaagctcccagccgccgtcgatgccgacgacgccaaggtctttaataccggactccgcacagttccgcgggcaggcagacacggccattttgactttatgaggtgtattgagcccttcgaattttttctccagcgcaatgcccagtgccatggagtcttgcgtgccgaagcggcagaattgttcgcctacgcacgtttttaccgtgcggagcgtttttccgtacgcgtagcctgacggcatatcaagctcggcccatactttcggaagatcttcttttttcacgccgatgagatcaattcgctggccgccggtcattttcacgagcgggatttcgtatttgtcgacgacatcggcgatcttgcgaagatctgtggaattggtcacaccgccgtacatccggggaacgacggagtatgttccgtctttttgaatattggcgtgcatccgttcgttcacaaatcgggaagttctgtcatcctcgtacgtagccggattgatcatgcctaagtagtagttgagggcaggccggcatttggagcagccttccggcgttttccagccgagcacgttcatgatttctctcgtatgtgacagccctttggctttgatttcttctacgacttcatctctcgacaatgaggtgcagccgcaaatcgcttctttttgcgcggatgcgtcaaattctgatcccagtgtgtattgaagaatgtcttcaacgagcggtttacagcctccgcatgagcgggatgccccggtgcatgctttgatttcgtccgtggatgtgcagcctttttcctgaatggcttgaataatcgcgccctttgatacgccgttgcagccgcagatgatttcatcgtcgctcatcgccgcggtcatacttgtacctgcttcctgatcaagaggctgtaaaattgatattttggaggtttcggagatatcggcttctttttgaatcattgaaaacaggcggccgccctcgctgctgtcgccgaataaaacagcaccgacaatttgatttcctctcaggacgatttttttatagatgccatcctgttcatcgaacactttaatcgcttttttgtcctctgattcgttaaagtcaccggcagagaacacctcgacacctgatacctttaattgagtggagagaacggaaccttcatacggttttgtttcgatgccgcaaatatgctttgcgagcactttcgcctgttcatagagcggcgccacaagtccgtatgcgattccgcggtgctcggcacattcgccgaccgcgtaaatgtgcgggatttcagtttgcatataatcattgacaatgatgccgcggttaaccggaatgccgctttctgcgccaagctgtgtattcgggcggatgccgacggccatgacgactaaatcagcttcaatgattgtgccgtctttaaagcgtacgccttcaacactgtcagtgccgaggatttcttcagtttgcttttcaagtaaaaaggtcatgccctgtttttctaattcgttttgcagcaggcgtcctgccgctgcatcaagctggcgttccatcaggaatggggcgaggtggatgacggacacgtccatgccgagattcagcagtccccgcgcggcttccaaacccagcagtcctccgccgatgacggctgcttttttatattgttttgacgcggcgagcatcgtgtctgtatctttaatatcccggaaagcagtgacaccttgtttatccgcgcccggaatcggtaggataaaaggtacggagcctgtcgccaggatgagttcatcgtaaggctggattctgtctgcatctgtgatgacggttttgctttccgggttcactttgatgactgtttcaccggtatgcagctgaatgttgttttctttgtaccagtcccaatcgtttaacgtaatatctttaatatctgtatcgccttgcagcacttttgacagaaggattcggttatagttgggatgaggttcggccccgaatatcgtaatctcgaattcgtcttttgaaacatgcagtatttcttcaattgctcttaccccggccattccatttccaacaaggactagctgtttttttcccatcagatgatccgctccttatctatgttttttttagcgtagcacagcaaaaacaaatatttaagatgcatgttatgaaatgtaacaaaaaatacgaaaaaatctaaaaattttatgaaaaattatatggggctgattcgtacggcgcacatcttaaaaccgggcattttacaatctgctgtttatcggaatgatggcgctcggcatgggtaacggagcggtatttcagcttgtcccgcagcactttagaaaagaaatcggaatggtgacgggaatcgtcggggcggccggcggcataggcggtttttttcttcccaatattttagggtcattaaagcaggtgacgggatcttatgctatcggctttatctctttttcatgtatcgcattgcttgcgtttgtgcttgttctcgcagcaggttattattggagaaaaagctatggcactgaaagcagccatgcggatgtttaagtttgagcggaagacacgtgtgacagcgtgtctttttcatgatgtataacttttacttgattttaaacggagaatacagcagaataaatagtaacgattgcgatttaaactgatgtacataataattgaaaagagacgggtatgtatcataaatcgtaatcattctattttatcaggaggatatgttcatgaaaaaaattccggttacagtattaagcggctatcttggtgctggaaagacgactgttttgaatcatattttacaaaatcgcaacggtttaaaaattgctgtcatcgtcaatgacatgagcgaagtaaacatagacgccggcttggtgaagcagggaggcggcttatcacggacagatgagaaacttgtggaattatccaacggctgtatctgctgcacgctgcgtgaggatctattagtcgaggtcgagaaactcgccaaagacggcaggtttgattacatcgtaattgaatcaacagggatcagcgaaccgattcccgttgcccaaacattttcttacatagatgaagaaatgggcattgatctgacagccttctgcaagctggacacaatggtgactgtggtggatgcaaaccgcttctggcatgatttccagtccggtgacagcctccttgaccgtaaggaagcggcgggagaagaggatgaacgagagattgctgatctattaattgatcaaatcgagttttgtgacgttctcattttaaataagcgcgacatggtgggcgaaaaagagcttgaacagcttgaaacagttcttcgtgcattacagccccgggccaagctgatccgatccgtccgcggagaggtgtctcccgaatgcatattaaataccggtttatttgagtttgaggaggcaagttcatctgcaggatggataaaggagctgacggcaggtcatgaggcgcacactccggaaacggaagagtacggaatcacttcgtttgtgtactcgcggcgtctgccgtttcataccgctcgttttgacagctggctgcatcaatcaatgcctgacaacattgtacgcgcaaaaggaattgcatggtgcgcaacccgcaacagccttgcgctgctgatgtctcaggcaggtccggcagtctcgattgagcctgtttcttattgggtggcggcgatgccgaaacttgagcaggagcagatcaaacagcaggaaccggaaattctggaggattgggacgctcaattcggagaccgccatacgaatctggtgtttatcggaactgatttagatcaagcagccatcacaaaggaattagatcagtgtctgctgacaccgtctgagttcgattctgactggtcgcagcttgaagatccttttcaatgggacattcagcgggctgaataacataccggccaagtttagaagcgggtgagaagggaaggagtgatgaaaaaggagctgaccaatgtgaaagcactgacataccaagggaaagaacatatggaagtgaaagaagtcccggcaccctccattcaagacgagagagatgtcatcgttcgaatcaccgcaaccgggatttgcggttcagatcttcatttatataaaaacggaatccccgccgatccgggttatatcgtcggacatgagccgatgggaatcgttgaagaaacgggcagtcaagtcaaaaggctgaaaaaaggcgaccgcgtcgtgatcccttttaacatcggctgcggtgaatgtcattattgcaagcaccagatggaaagccagtgtgatgaatcaaacccaaaccctcatacagatgccggcggcttattcggtttctcggagtttaacggtaattatcccggcgggcaggctgaatatttgcgtgttccttttgctgatttctcttcttttctggttccggcagacagcgggcttgaagatgagcaggtgctgcttctgtcagatgtcatgccgaccgccttttggagcgtccagcacagcggagtgaaaaaaggagacacagtcgttattctggggtccgggccgatcggtttaatggcgcaaaaattcgcttggaaaaaaggagcaaaacgggtcatcgcagtcgatcaagtcccgcaccgtcttgaacatgcgcgacgcacaaacggagcagagaccttcaatttttcagaacatgatgagatcggaaaactgctgcatgagcaaacgtcagggggcgcggatgttgtgattgattgtgtcggaatggacggtacgccgctttcaaaagaaaaagcagagcaaaagccgaatcagttcggaaccatcagtccgattcttacagcgtcagaagccgttaagaagttcggaacagttcagctcacaggcgcatatatttctgaagcggacggttttccgctcggtgattttttcacccgcaacgtctctttaaaaatggggcaggcacccgttatccatctgatgccgatgctgtatcaaatggtcgaacaaaatgaaattgatccgacggatatcattacgcataaaatgagtcttgcggaagcccctgctgcatatgatatatttgacaaaaaagaagatggcaatattaaagtgattttgaagccatagcgaggggaaacacaatgaatatttacagaccggcaggattttggatcagattgggagccttagtactcgactatttaattacttcagtgcctctggcgattatttttatgctggcaacaggaaaagatccgaatgatagcacaatgatcagcatcattttgactctttattctcttttgctcccagtttactggaacggttacgttatcggcaaaaagatttgcggtatccgcattgtcaaaaaagacggcactcaggtaggctttcttactatgattttaagagtgcttgtgggcgctttaatatatggcgtgacgtttggaatcggtgtgatcgtgagcgccttcatggtcggaatgagagaagacaaacggtcaatccacgattttgtagcaggaacgtatgtcacatacgcgctgccggatgaatcgattgaaaagagcgaataatttcgctctttttttttgcataaaaactggatgaaggcacaacatattacaaacgttaaaggaggaaagagtcatgaaaaaagctgcgttatcattggctgcgtttttcattacggcaatggttttcacaatgccggcacacgccgctgaaacgaaaatgccttcaacaatgtcacttacgcaacagcagaaaaaagaaattgaatcacttgaaaaagaaatactcgaaaaacgcaaacatgtcatttccaaatatgttgagtacggcgtcctgccgaaagaaaaagcagagcatattaaacagcatatggacaggcactttaatatgatgaaacaaaacggctttattccaaagcctccccctcataaactggaaaaacggcatcatcattcttaagcatccggcaagtcggatgcttttttgtttttatcgggattgctttgaaacgcgtttcataacgtatgatattaatatcatacgcatcaggaggatgaaaacacatgatacatgaaaaaccgggtcttttccctgatacatttctatgggggtcagcttcagctgcctatcaggttgaaggagcctggaatacagacggtaaaggcccttcagtatgggactttttcacaaaaataccgggtaaaacatttaaaggctcaaacggtgatacagcagtcggccattatgaacgttataaagaagatatcgccttgatggcagagatgggtttgaaagcttatcgcttttctgtcagctggccgagaatttttccgaaaggcagaggggaaatcaacgaagcagggatcgcattttatgaaaacttgatcgatgaattgatttctaacaatattgagccggtgctgactctctatcattgggacttgcctcaggcgctgatggatgagtacggcggatttgaatcaaggaaaataattgatgattttaataattactgcgttgcgttatacaaaagattcgccggaaaggtgaagtactgggtcacgttaaatgagcagaattataattttcataacggattcattacagcttcacatccacccggtgtaaaggacagaaaacgattttatgaagcgaatcatatcgcatttttagctaatgccaaagcaattgaatccttcagaaaatatgttcctgacggcttgatcggcccgagcttcgcatattcaccggcttatccgctgacaagtcaccctgaagacataactgcatttgaaaacgcagaggaatttatgaatcattggtggcttgatatgtactgctgggggacttatccgcaaattcctttcagctatttaaaggaaaagggctgggcgcctgccattgaagccggcgatatggagctgctggcaaaaggcaagccggatttcatcggtgttaattattatcagacgattacgtatgaaagaaatcctcttgatggtgtatcggaggggaaaatgaacacgacggggcagaaagggacaaaccaggacacaggtataccgggactgtttaaaacgaaaaagaatcctgatcttgtgacgagcaattgggattggacgattgacccgacaggcctgcgcatcggcctccggcgtataacgagtaggtatcagcttccggtttttgttacagaaaacgggctgggggaattcgataaaatagaagaagacggctcgattcaggatgactacagaatcgactatttacgctcccatcttgaacagtgcagagaggccatcagtgacggagttaatctcatcggctactgcagctggtcatttacggatctgttaagctggctgaacggctatcaaaagcgctacggctttgtatatatcaatcgtgatgaagaagacgaaaaggatctgaaacggatcaggaaaaaaagtttttattggtatcagaatgtaattgaaacaaacggtaagagtttataaaagttccctgagagaaatatgattctctcagggatttcttttacattgcggccgcatcaataatatacgtatctgcatgaagatcggatatttcggcaggcactgaataacaggtaaggctgtatcggcctttcggaagatcgaagaaaagcctttttgacatcacgctttcaatttcaatcccatcttttacagcctcgaagggaacagtcgcttttttctcataggatggcaccggctcatttgtgttcagcctcaggacgataaatgccttcgtatttctccctgcttcaaatgaaacagcatcgtcagcctccgcgtatcctttttcaatggcttcatcggtccaatcgataacaggcggttctgaatctttttggaagattgtaaattgatgataagaaatggtcagttcttgcggtttccatgatttaatcaatgcgctgttcctcctgttttttacttgattttaaataatactctcgttccgtctggatcattggtaagctggtgtccgacccaagagccggctccgcggttgtctgccggagaaatatattctacggaggcattatttccgccctgtttacaaaccgccatcggccattcatccctatcgtatcctgtttttacaggcacatgtttaagagattgttcacgccgcttatgtactccgtctctgtcaatggtgcatatgctggaatgtccttcttttatcgcgtccttaatatgctttgctgtttccggatatcgatcggacggaaataggattaccttgtcgtaatcactcttctgaacggtctgctcgttatctgagaaaatatcacccttgatcagggccgcgactgctccggcaatgatgataagaacaagcagcagtgcttttaatgttttcaagagtatcaatcacctccagttttaaattgctgtgaagctggtccaagaataaagcagaatcgtcccgctgtaaagctgttaaaatatatttttcagccgcaattctgctgaatatctgtaaaaccgtccgtacaaatccgctttatccaataaaaaaccgatcagaaagtgttttttgccgtttctctattcagaaatgaatgattgcggccgtctgaataattggctattatagcgataagctcaccggcagggtaattcgtcggcgagtttccgccccgtgacggtttgtaattctgcgcgacggaacgataaaaagacggccatcttataagaaggccgtcagcatgtcattccagattcgcatgttttgtaaacatatctgccgaattcagttcttttttctccatgatttttaggataaccgcatcataaaacagcagaagagtttgttcgaataaagaacccatcggctgaatcgtctttctgtctccgtctgtctcttccttaggagagcctgggatcgttatcgtgagatccgcaagtttgccgagactcgaggcggggttaatcgttaatgcagtgatgatgccgttaaggcttttggctttttcggctgtgtggaggagactttttgtttctcctgagccggagccgatgatgacgagaccgccttcttggaggggaggggtaagcgtctcaccgacaatgtaagcgttcagtccgatatgcatcatcctcatggcgaacgctttagccataaaaccggaacggccggctccggatgtgaagatctgatctgccgataaaatctgctccgcaagcttgtcagcttcactgtcggctattaatgatgcggtacgggataattcattcaggatgtcatgtaagtattcagtcgttttcatgatccttgtgtgatcagctgtttcatttttgaagcagcatccgctttatcgtcagcgcccgtaatccctccgccaacaatgattaaatccgggttttgtttgatggcttcaggaagcgtatcaagtttaatgcctccggcaattgcggtttttgtgttcttgaccgcttttttaatcgccgtcagttccccgaatgaattttttccttctgcttgaagatcataacctgtgtgaacacaaatataatcaacaccgagttggtcaatttctgttgcccgtgtttcaaggtcttttacgttaatcatatcgacgaggatttttttctgctgcttttttgcttcagaaaccgcccctttgatcgttgagtcatctgttgcccctaaaacggtgatgatgtcggctcccgcttctgccgctttcataatctcgtaaccgcccgcatccatgattttaagatcagcaagcactttcagatgaggaaaggcctccttcatttgctgtacggctctcagtccttcattaatgacaaccggagtgccgatttcaacaacatctatatattgttcgacctctttcacaagttcaattgcttcaggaatattcactaagtctaatgcgagctgtaattccactttatatccactcctcttcttaatgtatttacattctatagagcgtcccgcatgttgagaagtacgcactttgaagtctaatagttaccttgaggatactgtccccgcaggcaatgcgctttgtttcagcaaaactgcgtggtagtataaactgatgaaagctctgtgaaaaagtaagtgtgtattaatagatgatgaacatacgaaaagtcagaggaaggagagttgtccgtgagccgaatggataagaagacgtttaattgcgaaaaggaattgacgcttgccgtgataggcgggaagtggaaaatgctgattatgtggcacttggggaaagaaggaacgaagcggtttaatgagctgaaagctttaattcctgatattacgcacaaaattcttgtgaatcagctcagggagctggagcaggatctgatcgttcacagggaagtttaccctgtcgtccctccgaaagtggagtactctttaacggcgcaaggagagagccttatgccgattctggacgccatgtataagtggggaaaagaatatatggaattaatcaacattgataaaactgcaattaaggaatctttttgaagcgctctatgtaaaatagagtgcttttttttgcgggttaatgaaatcatattgcgaacggttgaacctcctgtttcggttcttgcgctttttttcttgtatcggcttacatatgttaacttttttcattctgccataatgggatattcggcagattttatactatagtttaaagatttttaattttacgtaaataatattttttgaaaataaattgcgggatgccgcaaaaatccctctggatttgtcggaatttttttcggtgtgccgcatgaaacttttcacccgtttttcggtgataaaaacaatattttcatataaagtgaacgtaagtagatatatagaaattcatgaagaaataggtaaacctttcgtgcttacaatcttgacttttgtctggatttcccataatttgatgccgaaatttcggtctttacaagtaatggatgacggatttcggcggtgttttgaatcgggatgttttggaggtaagtggttcttttggcttgagaatgagttagggacattgagggaggctgtttctaaggaagaattgacaattttatcttaaaaagggaggcgtacacatatgggaataactttttatcctttaacaaatgctcaaaaacgtatctggtatacagagaaattctatccgcacacaagtatttcaaaccttgccggcttcgggaaactcatttctgaagacggggtacaagcccatttcgttgagaaagcgatacaggaattcgtccggcggcatgagtcgatgagaatccgtcttcggcttgatgatgagggggagcccgttcaatatgtgagcgaataccgtccgctgactatcaagcatacagatatcaggcaagccggttgctctgcggacgagctgtcaaaatgggggcgtgacgaggcaagcaagcctctggcgttatatgatcaggatttgtttcgtttttccgtgcacaccatcagcgaaaaagaggtttggttctatgttaatgtgcatcacgttatttcagacggaatttccatgacgattctgggcaatacgattaccgatatttatttggagctttcgggcggagcaagtgagaacgaggcggagattccttcctttatcgagcacgtgctgacagagcaggaatatgtgcagtcgaagcggttcaaaaaggatcgggatttttggaacggacagtttgagaccgtaccggagcttgtgtctttaaaacggagccaggcagatgcggggcttgatgcgaaacggttttctcaagaaattcctcatgacctgtacggccggattcaatcattctgcggggagcataaggtcagcgttctttctctgttccagtcagctctgatcgcttatctctacaaagtaacaggccgggatgacgtcgtcacgggtacgtttatgggaaaccggacgaatgcgaaggaaaagcagatgctcgggatgttcgtatctacggtgcctgtgcggacaagcgttgatggaggacagtcgttcttggaattcgtgaaaggccggatgaaggatctgatgaaaattctccgccaccaaaagtatccgtataacctgcttgtcaatgatttgcgcgcttcgaaaagttcgctgagcagattgtttacagtatctctggagtatcaggtgatgcagtggcagaaaaaagagaatctgtccttcctgacagacccgatcttcagcggaagcggaacaaatgatatttcgattcatgtgaaggaacgatgggacaccgggaaattgacgattgattttgactatcgcagtgacatattcaaagccgaggaaattaaatctgtttctgaacgtctgatcacgctgattgaagatgcgatttcatctcctgatcgcgtaattgatgagctcgctcttctttcggattctgagaaagaaatgcttctgaaacgggcctctggcaatcaggtggcttatcgcaaggagatgacgattccggcgctgtttgaagagaaagcgaagtcactgcctgacaaacccgcggttgtatatgaaggccgaacattgtcctacagcacattacatgatcagtcaaaccgtatcgctggacgccttcttaaagccgggatatcagcggactctcctgtcgcggtgctgctcggccgttctgaacgtgtcattgcggcaatattgggaattttgaaagcgggcagcgcatatgtgccgatcgatcctgactttccggcggatcggattcagtacatattggaggacagcggagcgaaggccgttctgacagaggccgggatacaggcgcgtgaaactgatgctgaatggattgattttgacgaggccgttcagtatgaggcggctgctgaaggtgtcggcactcaatcagaccggctggcttacattatctatacgtccggcacaacggggcggccgaaaggcgtgatgattgaacaccggcaagttcatcatctggttcaatcactccagcaggagatatatcaatgcggtgaacagacattaagaatggcgcttttggctccgtttcattttgatgcgtccgtcaaacagatttttgcctcacttcttctgggtcagacgctttatatcgtgccgaaaacaactgtaacgaacggctcggcactgctggactattatcgccaaaaccggattgaagccaccgacggaacgcctgcgcatctgcagatgatggttgcggcgggagatgtcagcggaattgaactgcgccacatgctcatcggcggagaaggcctgtctgcagctgttgctgaacagctgctgcaactctttcatcaaacgggcagagcgccgcggctgacaaatgtctacgggccaacggagacgtgcgtagatgcgtccgtgcacccggtgtcagcagataacggaatgatgcagcaggcggcgtacgttccgatcggaaaaccgctcggaaatgcccggctgtatatattggataaacacaaacggcttcagcccgacggtacggccggtgagctgtatatcgctggagacggtgtaggccgcggctatttaaatcttccggatttgaccgcagagaagtttttgcaagacccgttcagtgagagcggccgcatgtaccgtacgggtgatatggcacgctggctgccggacggcacaatcgaatatatcggccgtgaagatgatcaggtgaaagtccgcggctaccgcattgagctgggagaaattgaaacggtgctcagaaaagctccgggcgcggcggaggccgtcgtgctggcacggccggatcagcagggcagcttggatgtttgcgcctatatcgttcaggagaaaggaaccgagtttcatcctgccgagtacagggagtatgtgtccaaacaccttcctgattacatggtgcctgcttactttacaaaaacggataaaattccgctcacgccgagcgggaaggcggaccgcaaaaagctgttcgcgcttgatgtgcaggctgtcagttcgtccgagtatgcctcaccgagaaatgaaacggaggaaacgctcgccgtcatctggcaggaagtactcggcatggacaaggcgggtatttatgatcatttcttcgagtcaggcggtcattcattaaaggcaatgacgcttctgacgaaaattcataagcaaatgggcgttgaaattccgctgcagtacttgtttgagcatccgacaatcgcggcgcttgccgattatgcggcaagccgaaacgaaggaccggctttcagtacgattgagccggctgagaagcaagcgagctatccgctttctctcgctcagcagcgggtttatatcgcgagccaatttgaagatgcgggagtcgggtataacatgccggcggcagccatgatcgaaggcgctttagatcgtgaaaaacttgagcgtgcattttctgccttaatcagcagacatgaagcgctcagaacatcgtttcaatcagaagacggcacgccgagacaggtgattcatgagcaagttccatttcatattgaagtgattgaagcgggcggaagaacgaatgagcaggtcatgaaggactttgtgcgccgttttgagctggaagaggcgccgctgttcagaatcggtctgcaaacgctcggtcacaatcgccatatgatgctgtttgatatgcaccaccttatttcagacggggtgtctatttccatcatgctgaaggaacttgcagacatctatggcggaaaacagctgcctgaattgagcattcaatataaagattacgccgtctggcaggcggaacgggcggaagaaggctacaagaaggagcgggcatactggaaggaagtcttcagcggcgaactgccggtgcttcagctgctccctgattatccgcggccgcaggtgcaaagctttgaaggtgaccgcgtgtcagtcaagctgccgaaaacgctgcgggaacggctgcaaaagcttgccgagaaaaacggagccaccctttacatggtgctgttatcggcatattatacgctgctttctaaatattcaggacaggaagacatcatcgtagggacaccgtcagcgggaagacaccattctgatactgaggggttgatcgggatgtttgtcaacacccttgcgctgcggagcaccgtgaagcaggatcagacatttacaggcttgttaggccatgtgcgcaagcaggtgctggacgcgttttctcatcaggactatccgtttgagtggctgaccgaggaactgaatgtgccccgggatatgagcaggcacccgatatttgatacgatgttcagcctgcaaaatatttcggacggaattccggagatcggtaatctgacactgtctcttcatgaaacaaacttcaatatcgccaagttcgatctgacaatgcaggccagggagacggcagaaggcgttgcgcttgatctggactattgcacgaagctgtttaagcggtcgactgctgaccgtatgcttacgcattatgtccgcctgctggagagcgcggcagctcagccggaagcgaaaatcagcgaatatgatctgctttctgaacgggaggctttgaaccaattacagcggttcaacccggaacgcacggcatacccgaaagatcaaacgatcgtgcagatctttgaagaacaggctcaaaagaacccggaccggacggctcttcagttcgaaggggaaaccctgtcgtatcaacagctgaatgaacgggccaacaggcttgcgcggcatattctttcggccgggggcagcggaaaaaccgcggctgttttgtgtgaacggtcattggatatgattgtttccattatggctgtgttaaaagcggggtccgcctatgtgccgattgatcctgagcatccggttcagcggattcagcatttcttccgtgacagcggggcgagtgtgctcctgactcagcgaagcctcaagccgattgcggaaaaagccggttttcaaggcgtcatcgtgcttgctgatgatgaggagagctatgaaaaggactctcacaatctcgcgttgccgtttgattcaaaaaccattgcgaatctcacttatacatcaggcacgacgggaacgccgaaaggaaacatcgtcacacatgccaacatattacggacggtaaaaaacacgaactatttgaccgtttctgaagaagacacggtgctcggactgtcaaactacgtctttgacgcctttatgtttgatatgttcggttcgctgttaaacggtgcaaagcttgtgatcgttccgaaagatacggtgctggacatgtcccgcttgtcccgtgtgatcaaacgggagaatgtaagcattctgatgattacgacggccctgttccacctgcttgttgatatggagccgtcctgtctgacgacgcttcggaaaatcatgttcgggggcgaaagagcgtctgttgagcatgtcaagaaggcgcttgcggcagtcggaaaaggaagactgctccatatgtacggcccgtcggaaagcactgtatttgcgacataccatccagtggatgtcattgaagaggatgcgatctccgttccgatcggaaaaccggtcagcaatacggaaatcttcatcatgaacaaggccgggcgaatacagccggcaggcatcccgggagaactgtgcgtcagcggggaaggcctcgtagaaggctactacaaccgtcctgaactgacggaagaaaaatttgtaaaacatccgtttaaggaaggtgaacggatgtataaaacgggcgacttggccagatggctgccgaatggcgatatcgagtttatcggacgtatcgaccatcaggtgaaaatccggggacagcggattgagcttggcgaaattgagcatcagctccaaagtcatgaccaggttcaggaatgcatcgtgctcgctgtagaccagggcgcgggtgacaaacttctttgcgcgtactttgtcggccttagagaaatatcttcccgggaactgagggagcatacggcgaaggatctcccggcttatatgattccggccgtctttattcaaatggatgaattgcctcttacaggaaacggaaaaattgacaggcgggcgctgccgatgcctgatgtgactgcagcgaacgccgtgtcatatacggcgccgcgcaatgaaacagaacaaaaactaacggatatttgggctgaggtgctgcaaatggagcgggttggcatccatgatcagttctttgagatcggaggccattcgttagcggggatgaaactgcttgctctcattcagcagacattcggcgtccggcttacattaaaggatctgttcacttctccgacggctgcgggcctggcgaagctgattgccggatctgaacggaaggcggctgagagtatcatgcctgctgccgtgcgggaaacgtatccggtttcttcaccgcagaagcggatgttcgtgcttcagcagctggaaggcgctgaaacaagctataacatgccgtctgtgctgcgtttaaaaggaaagcttgatgcagaaaagctgaaatccgtcatgaaacagctgacagagcgccatgaagccttcagaacgacgtttgacataaaggatggagaaacggttcagcgtatatgggccgaagctgatattgacatggaatattacgaagcctctgaggaagacgctgaacaaattattcagagctttatccggccgttccgcctggatcagcttcctctcgtcagaacgggcctggtcaagctggctgaacatgatcacctgctgttgtttgacatgcaccatatcatttcggacggcgcttccgtaggcgtgctgatagatgaactgtcccgcttatatggcggcgaaacgcttgagccactgcggattcattataaagactatgcggtatggcagcagacatttattgaatcagagcagtatcgcaagcaggaggagcattggcttcgggagcttgacggcgagcttccggtattgacgcttccggctgattacagccgtcctgccgtgcaaacctttgaaggagacaagctggtcttttctctgacggagaagcagacgtcggctcttcgcagtcttgcgaaacaaacgggttctaccatgtacatggtgctgctggcgtcatacagcgcttttctctcaaaactgagcggacagcatgacatcattgtcggctcaccggtcgcgggacggtcacatgcggatctcgcaaacgtcatcggcgtatttgtgaatacactcgcgcttcggacgtatccggaggcggacaaaactttcgcggattatcttgaagaagtgaaacaaaccgcattacgtgcatttgatgcacaggattatccgcttgaagacctgctgcaaaaggttgaggtgcagcgtgatacgagcagaaatccgctgtttgatgcggtattctccatgcaaaacgcaaatgcggaagatctggtcatggaaggaattgagctgaagcatcatccgtttgacagaaaaacagccaagtttgatctgacaatgacggccgatgacacagacggaggcctgacgtttgtgcttgaatataacaccgcgctgtttaaaccggaaacggcagagacatggaagcattattggctccatctgttagaagccgcagcggaaaatccggctgcgaagctttccgagctttcattggtgaatgaaacagaaaaacaagccctccttaacgcatggaaaggaaaaacgctttccgtgccgcgggacaaaacggttcaccgtctctttgaagaaacggctgcccgccacacagaccgcccggccgtggcatacaacggcgtgaaatggacgtacggcgagctgaacgcaagggcgaaccgcatcgcccgcatcctcatggattgcggtgtcacggctgacgaacggatcggcattttgacgaaaccgtccttggaaatggccgcgggcgtactcggcgtcctgaaagcgggcgcggcatttgtgccgattgacccggactatccggaagaacgtatcagctacattctgcaggacagcggcgccaagcttcttctcacgcaggaagcgctcgatgtgccggacggctacaccggagaaacgattctgcttgacggcagccgctcgattctgagcctgccgcttgatgaaaatgatgaagcgaacccgcagacagaaacaacggcggatcacctcgcttatatgatttacacgtcgggaacgaccggacagccgaagggtgtcatggtcgaacaccatgcgctcgtgaatctgtgcttctggcaccacgacgcattcgccatgacggcggacgataagagcgccaaatacgcgggcttcggttttgacgcctccatctgggagatgttcccgacatggaccatcggcgcggagcttcacgtcattgacgaagcgatccggctggatatcacccgcttaaatcactatttccaagagcacggcgtgacgatcaccttcctgccgacgcagctggccgaacagtttatggagctggaaaatagctctctccgcatgcttctcgtcggaggcgacaagctgaagcgggcggtgaaacagccgtacacgatcgtcaacaactacggcccgacggaaaacaccgtcgtcgcaacaagcggcgtgatcaatccggaggaagattcgctttcaatcggacgggcgattgccaatacgagagcttatattctcggcgacggcgatcaggtgcagccggaaggcattgccggtgaattgtgcgtggcaggccgcgggcttgcgcgcggatacctgaaccgtgaagaagaaacggcgaagcggtttaccgccgatccgtttgtgcccggcgagcgcatgtaccggaccggcgacctcgtcaaatggaacacgcagtgcggcatcgaatacatcggccgcatcgaccagcaggtcaaagtgcgcggctaccggatcgagctttcagaaattgaagtccgcctcgcccagcttgcgggagttcatgacgcagccgtgacagcggtggaagacaaagcgggcaataccgcgctttgcgcctatgtcgcgcctcagcagacggacatcgaagcgctcaaagcggcgttgaaagatacccttcctgactacatggtgccggcgttctgggtggagatggacgagcttccggtcaccgcaaacggaaagattgacaaaaaagccctgccgtcgccggacattgaagcgggaagcgccgcgtacaaagcgccggaaacggaaatggagacgctgctttctgacatttggcaggaagtgctcggccttgaacagatcggcgtaagcgataatttcttcacgctcggcggcgactcgatcaaaggcatccaaatggcgagccgcctgaaccagcacggctacaagctggagatgaaggatctcttccagcacccgaccatcgaagagctcgtctcctatgtggagcggacggaaggcaagcaggccgatcagggccctgtcgaaggcgaagcggacttaacgccgatccagcgctggttctttgagaagaactttacggacaaacaccactggaaccaatccgtcatgcttcatgcgaaagacggctttgatccggctgtaacagaaaaaacattacatgtactgacggcgcatcatgatgcgctccggatgatttatcgcgagcaaaaaccgtattacagagggcttgaggatgcccctgttgaactgaacgtctttgagctgaacggacttgctgaagatcatgaagaccgtatcgaacgggaagcagatcgtcttcaaagcagtatttcactggaaacaggacctctgctgaaggccgggctcttccgggcggaagacggagatcaccttctccttgcgattcatcacttagtcgtagacggtgtatcttggcggattttactggaggacttcacttccgtttatacacagctgaagcaaggcaatgaaccggcgctgccgccgaaaacacattcatttgcggaatttgctgagagaatcaaagaatacgcaaatacgaaggcgtttctgaaagaagcggattactggaaagagcttgaggaaaaagaggtatgcactcagctcccgaaagacaggcagtcttctgatcagcgcatgaaatatacaagaacggtcagcttctctctgacagctgaacaaactgaacagctgacgacaaatgtacatgaagcctaccatacggaaatgaacgacatcctgctcacggcgctcggactggcgctgaaagagtggacgggtgaagacacgatcggcgttcacttggaaggccacgggcgcgaggacattcttgacggcctgaatatcacccggacggtcgggtggtttacgagcatgtatccgatgatccttgagatgaaacacgccgacgatctttcatatcagctgaaacaaatgaaagaagacatcaggcatatcccgaacaagggagtcggttacggtattctgcgttatgtaacggcgcctgagcataaagagaatctgtcgtttgagattgatccggatatcagctttaactacttaggacagtttaatgagatgtcggattccggcttatttacaaggtccgatatgccgtcaggacaatcgctgagccctgacacggagaagccgaatgcgcttgatattgtcggatttatagaaaatgggcagatgacgatgacgtttgcctatcattctctcgaatttcatgaaaaaaccattcaatcgttcagtgacagctttaaagggcaccttctggaaatcatagatcattgcctgtctcaagacggccctgaacttacgcctagtgatcttggtgatgatgatctgacgcttgatgaacttgataaattaatggaaattctttaacagaaaaggcagaggtgacttatgagcaaaaaatcgattcaaaaggtgtatgcactcacaccgatgcaggagggaatgctgtatcatgcgctgcttgatccgcattcttcctcctacttcacacaattagagcttaggattcatggatgctttcagcttgagctttttgaaaaaagcgtcaatgagctgatccggacatatgacatcctgcgtacggtattcgtgcaccagcagcttcaaaaaccgcgccaagtcgtattggcggagcggaagacaaaggtgcactatgaagatatcagtcaattagatgaagaacggcaaaccgaatatatagagcgctataaacgcgatgtgcagcagcagggttttcatctggcgaaggatattctctttaaagcggcggtattcagactcagtgagaaggagctgtatctcgtctggagcaatcatcatatcgtcatggacggctggagtatgggcgttttgatgaaaagcctgtttcaaaactatgaagcgcttcgtgccggccggcccgccgggggaagccagggcaagccttactctgactatatcaaatggctcggaggacgggattatgatgaggcggaacaatattggagcagccgcttggcggatttcgaacagccgagtctgctcccgggccgtctggcatcagaaaagaaaggctaccaaaatgaagaatattcttttgtctgggatgaagagctggtcgcgcaaattcagcagaccgccaaccggcatcaagtcacggggcctaacttgtttcaggccgtttggggcgcggtgctcagcaaatacaactatacagacgatgtagtgttcggaactgtcgtatcaggccgtccttcagaaatcaacggcattgaaacaatggccgggctgttcatcaatacgattcccgtcagaatcaagattgacaaagaagcatccttttctgacgtgatgacggcagttcagaaaaacgcagtggaagctgagcgctatgattatgtgccgctctatgacattcaaaagcgctccgctctggacggcagcctcttgaatcatttggtcgcgtttgaaaattatccgctggacaaagagctcgaaaacgggggcatggaggaaagactcggattttccataaaagtggaacatgcttttgagcagacgagctttgatttcaatctcatcgtttatccgggaaaaacgtggactgtcaaaatcaaatacaacggggcggctttcgctcatgatgccatcgaacgaacggcgcatcatctgacgcgcatgatgaaagcggcggtcggaacgcctgatgcccccgtgcgggatctcggccttgtttcaggcgaggaagaacggcagattgttgaaatattcaatgatacgaaaacggagcttccaaaagaggaggccgttcaccgtttgtttgaagcacaagcaaaccggacgcctgcaagcatcgcgataaaagaagatggacacgagtggacttaccgcgaagtaaacgaagcggccaaccgtctggcgagacatcttgtcgggaacggactggaaaaaggccggaccgcagctattatgaatgaccggtctgcggaaaccgttatcggaatgcttgccgtcttaaaagcagggggcgcatatgtgccgattgatccggcatttccggaggaccgtctccgcttcatggcggaagacagctcgattcagctcgtgctgacggttcaggcttatcaagaacaagcgggcacattgcaagttccggtcatcatgctggacgaaagcacggatgaaaaggtaagcggaacagacctgaatctcccttcaggcggaaacgatctggcgtatatcatgtatacatccggatcgaccggcaaaccgaaaggcgtcatgattgaacacagaaatatcatcaggctcgtcaaacattcgaattacgtgccggttcatgaagaagaccggatggcgcaaacgggagccgtcagctttgatgccggaacctttgaagttttcggtgcattgctgaacggagcttcgctgcacccggttaaaaaagagacgctgcttgacgccggacaattcgctcaatttcttaaagagcagcggatcacgacaatgtggctgacatctccgctgtttaaccagcttgcccaaaaggatgccggtatgtttaacacgctccggcacctcatcatcggcggggacgcgcttgtaccgcatatcgtcagcaaagtaagaaaggcgtcaccggagctctcgctttggaacggctacggcccgacggaaaatacgacgttttcgaccagttttctcattgatcaggactatgaaggttctgtcccgatcggtaagccgatcggaaattccactgcatacattatggacgaaaaccgcaatcttcagccgatcggcgcacccggtgagctgtgcgtcggcggaagcggagtggcaagaggctatgtgaatctgcctgaattaacggagaaacaatttgtctgtgatccattcagaccggatgaaatgatataccggacgggcgacttggcgaagtggcttccggacggcacgatcgagtttctcggcagaattgacaatcaagtaaaagtccgcggtttcagaatcgagctcggcgaaatcgaggcgaaaatcagccaggcggagaatgtgacggaatctgccgctgtgattcggaaaaacaaagcggacgaaaatgaaatctgcgcttactttacagcagaccaagccctttcgccggaagacttgcgcaaagcgctttcggaatcacttcctgaatacatgattcccgcgcacttcatccagatgaatcagtttccgctgacggcgaacggaaaaattgataaaaaggcgctgcctgagccgcagactgaagccgttcaaaaagaatacgaagcgccgaaaacggaagcggagcagaaactcgcggacatttgggaaggcattcttggggtaaaagcgggtgtgactgacaatttcttcacgattggcggacattctttaaaagccatgatgatgaccgctaaaatccaggagcattttcaaaaagaagtgccaatcaaagtgttatttgaaaagccgacaatccaggagcttgcgcattatttgcagcatgagagcgaggaggagcagcagtttgaaccgatccgacaagcgccttatcagaagcattatcctgtttcctcagcacaacgcaggatgtatatcctcaatcagcttgggcaggccagcacgagctacaacgtccctgctgtacttttgctggagggatcggtagacaaaaaccgtcttgagggggccatgcaggcattaatcaatcggcatgagacactgcgtacatcgtttgacatggcggatggagaagtcgtgcagaccattcataaaaatgtatcatttgagctggaaaccgcagaggtacgggaagaagatgcggaagagctgacaaaagcctttatcagaccgtttgcgctcaatcgtgcgccgctcgtccgttcgaagctgatccggattgaagaagatcgctatcttctgctgattgacatgcaccacattattacggacggcagctcaatgggcattttcatcggtgatctggcgaagctttatcaaggcacggagcttgcgccgccaaagatccattataaagatttttcagtctggcagcgtgaaaaagcaaatctcgatcagcacgaagcttactggctcgataggttcaaaggcgatctgccggtgctggacctgccgcttgatttcccgcgtcctgccgagcgcagttttgaaggggaacgcgtcattttcggacttgataagcaggtgacggcgcagattaagacgttgctggctgatacggatacgacgatgtatatgttcttgttagccgcttttcaagtgctgctctccaaatattcaggacaggaagatattatagtcggatctccggcagccggaagacagcatcctgatctccaagaggtgccgggcatgtttgtcaacacagttgcgcttcggtcgcatccttccggcaaaaaaacgttcaagcaattcctggacgaggtgaaaacggcgagtctgcaagcttttgagcatcaaagctatccgcttgaagaattaattgaaaaactgccgttaacgagggatacaagccggagtcctctgttcagcgtgttatttaatatgcagaacatggagatcccgtctctgcggctcggtgatttgcagatttcttcatattccatgcatcatcatgtcgctaaatttgatctttctttagaagcggctgaacgcggagaagaggtcggattgagctttgattatgcgaaagccttatttgcggatgaaacaatccgccgctggagcactcattttgtcaatctgattaaagcctgtgccgaaaatccggatattcagctggctgatgcaagtctgctgtctgcttctgagcgggaagcgctcctttctgatgaaaaacgtacggaagcggacctgcctgaaggcacttttgtttcgctgtttgaacggcaagcgcaaaaaacgcctgatctcacggcggttgcaggcggaacaagtctgacatatcgcgagctcgatgaacagtcgaaccggtttgcgcgccacctacagtcctgcggagcgggcagtgaggacatcgttgccattatgatggatcgttcggctgacttaattaccgcgattctcggcgtcatgaaagccggggctgcgtttctcccgattgatccggaaacgcctgaagagagaatccgctactctctggaagacagcgggacgaagcttctcgttgtcaatgagagaaatatgaccgcggctgccgtttataacggaaaaacggtcgtaatggaagacggagaatggcggaatgaaagcgccgatcggctcgaaacggagcccggcgccggtcagcttgcttatatcatttatacctcgggaacaacgggcaaaccgaaaggcgtccagctggagcatcgcaatctggtcaattatgtcacatggttcagccgtgaagccggtctgaccgaagctgacaaatccgtgctgctgtcttcctacgcatttgatctcggatacacggccctgttcccgatccttcaggcgggaggcgagctgcacattgtgccgaaagagacgtacaccgcgcctgatcagcttggtgagtatatagagaaaaacggcattacgtatatgaagctgacgccgtcattgttccatatgatcgtcaatacagcccgttttgcggaagaacgccgtttcagcccgcttcgtttagtggtgctcggcggtgaaaaaatcattacgtccgatgtccgcaagtttcatgacgtatacgcccatacggatttcatcaatcactacgggccgacggaaacgacgatcggcgccattgccgggcggatcaatatggagcggcttgatcaatatgagcagcgccccgtcatcggccgcccgatcgcaaataccggtgcgcttgtgctggacggatcaatgcagcttgttccttcgggcgcaagcggtgagctttatatcaccggaaaggggcttgccagaggatatctccaccgtccgcaactgacggctgagaagtttctccccaatcctttttcaccgggcagcctgatgtacaaaacgggagatgtcgtccgcaggctttctgacgggacgattgaatttatcggccgtgcggatgaccaggtgaaaatccggggctaccgcattgaattaaaagaggttgaaaccgtactgttaagcataaacggcattcaggaggcggtcgttctcgcggtcagcgaaggcgggctgccggaactgtgcgcgtactataagtccgacagcgacctgaaaggctccgagcttcgcaaacggctttccgaaacactcccgtctcatatgcttccggcctatttcgtgcaggttgaccatattccgctcacagccaacggaaaaacggataaaaacgctcttccgaaaccgggcgcaagccaaacggcgcaagcggcttcagccttgccggaaacggagctggaagagaagctgtgccgcatttggcaaaagacactcggtgcggattctctcggcatcgacgataatttcttcgattacggcgggcactctttaaaaggcatgatgcttctcgccaatattcaggctgaactggacaaaacggttccgttaaaagcgctgttcgaacagccgactgtccgccagcttgccgtatatatcgaaaaatcggcggtatctgagggatatcggatgatccggccagccggagcggctgacgtgtacccgttatcatccgcccaaaaacgaatgtacgtcctgaaccagcttgaccgggacacaatcagctacaacatgccgtccgttcttttgatggaaggagaagtcaatatttcaaggcttcaggaagcgctcaatcagatgatcaatcgccacgaatctttgcggacgtcttttatcgatcaaaaaggccggccgatgcagcggatcgcagaacaggcagacatcgagctgcacgtccttgaagcagctgatgaagagaaagccgatcttatcattcgggcattcattaagccgtttgatctgagtgcggctccgctcattcgggccgctcttgtcagattgaatgaaaagaaacacctgctgctcttggatatgcatcatattattgccgacggcgtgtccagaagcatgctggtcaaagagcttgcccatctttacaaaggcggaagtctgccggcgccgaacctgcattataaagatttcgccgtctggcagaatgaacctgagcaggccgaacggatgaaagagcatgagcgttattggctctctgcgttttccggcgagcttcctgaactgaatctgccgaccgattttcctcgtcctgcggttcaaagctttaaaggacaatccgtccgcttcagagcgggggttgaaacagaaaaagcggtgcgtgaattaatggatgcatcgggagcgactcttcacatggtgcttcacgccgcgttccatgtctttttgagcaaaatcacggggcagcgcgatattattatcggctcggtgaccgccggaagaacgagcgccgaagttcagcaaatgccgggcatgtttgtcaatacgcttgcgcttcgcaatgaaacgcgcaaagagcagaccttcgccgaactgctcgaacgggtgaaacaaaccaatctcgatgcgctggcgcatcaggaatatccgtttgaggatctgatcggaaagcttgacctgccgagagatatgagccgaaacccgttgttccaggttatggtgacgacagaagatccggataaagaaacgctggaactggagaacctgcgcattaccccgtatgagtcgaaccaaggcacggcgaaattcgatctgacgcttggcggctttacggatcaagaaggcctcggtcttcagtttgaatatgcgactgatctgtttaagaaagaaacaattgaaaagtggagcgccggcttcctgcgaattctgaaggaagcggcagaaagccctgacagaaagctgcctgagctttcactgatcagcgatgctgaacaacaagcccttcttaacgcatggaaaggaaaaacgctttccgtgccgcgggacaaaacggtttaccgtctctttgaagaaacggctgcccgccacacagaccgtccggccgtggcgtacaacggcgtgaaatggatgtacggcgagctgaacgcaagggcgaaccgcattgcgcgcattctcatggattgcggtgccacggctgacgaacggatcggcattttgacgaaaccgtccttggaaatggccgcgggcgtactcggcgtcctgaaagcgggagcggcatttgtgccgattgatccggactatccggaagaacgtatcagctacattctgcaggacagcggcgccaagctgcttctcacgcaggaagcgctcgatgtgccggatggctacaccggagaaacgattctgcttgacggcagccgctcgattctgagcctgccgcttgatgaaaatgatgaagcgaacccgcagacggaaacaacggcggatcacctcgcgtatatgatttacacgtcgggaacgaccggacagccgaagggtgtcatggtcgaacaccatgcgctcgtgaatctgtgcttctggcaccacgacgcattcgccatgacggcggacgataagagcgccaaatatgcgggcttcggttttgacgcctccatctgggagatgttcccgacatggaccatcggcgcggagcttcacgtcattgacgaagcgatccggctggatatcacccgcttaaatcactatttccaagagcacggcgtgacgatcaccttcctgccgacgcagctggccgaacagtttatggagctggaaaatagctctctccgcatgcttctcgtcggaggcgacaagctgaagcgggcggtgaaacagccgtacacgatcgtcaacaactacggcccgacggaaaacaccgtcgtcgcaacaagcggcgtgatcaatccggaggaagattcgctttcaatcggacgggcgattgccaatacgagagcttatattctcggcgacggcgatcaggtgcagccggaaggcattgccggtgaattgtgcgtggcaggccgcgggcttgcgcgcggatacctgaaccgtgaagaagaaacggcgaagcggtttaccgccgatccgtttgtgcccggcgagcgcatgtaccggaccggcgacctcgtcaaatggaacacgcagtgcggcatcgaatacatcggccgcatcgaccagcaggtcaaagtgcgcggctaccggatcgagctttcagaaattgaagtccgcctcgcccagcttgcgggagttcatgacgcagccgtgacagcggtggaagacaaagcgggcaataccgcgctttgcgcctatgtcgcgcctcagcagacggacatcgaagcgctcaaagcggcgttgaaagatacccttcctgactacatggtgccggcgttctgggtggagatggacgagcttccggtcaccgcaaacggaaagattgacaaaaaagccctgccgtcgccggacattgaagcgggaagcgccgcgtacaaagcgccggaaacggaaatggagacgctgctttctgacatttggcaggaagtgctcggccttgaacagatcggcgtaagcgataatttcttcacgctcggcggcgactcgatcaaaggcattcaaatggcgagccgcctgaaccagcacggctacaagctggagatgaaggatctcttccagcacccgaccatcgaagaactcgtctcctatgtggagcggacggaaggcaagcaggccgaccagggccctgtcgaaggcgaagcggacttaacgccgatccagcgctggttctttgagaaaaactttacggacaaacaccactggaaccagtccgttatgcttcatgcgaaagacggctttgatccggtactggtggaaaaaacgctgcaagcattgatcgaacatcacgatgcacttcgcatggtctaccgtgaagaaagggaaggcgtcattcagacatacctgcctgtcagtgaatgcaagacaagctttgaaatcgttgacctgtttggaactgacgaggatatgctgaaaagccagatccagcggcttgccgatcatcttcagggcagtcttgatctgcggaacggtccgctgctaaaagcagagcaataccggacagaacaaggcgatcaccttttaatcgcgattcaccatctcgtcgtggacggggtgtcgtggagaattctgcttgaggattttgcttcaggctataaacaggcacagcagcaaaacagcatcgttttcccgcagaaaacccactccttcaaagattgggcggaggcgctgcacacgtttgcgcagtcagatgagctgaagaagcaggcggattattgggcgcgggcagatgcggaacagctgccgcggctgccgaaagaccgtgatacgaaaaaacggctcgtcaagcatacggcggccgtgaaatgtgaactgactgaggaagaaacggcacagctgctcacggatgttcaccatccgtacggaacggaaatcaacgacattctgctcagcgcgctcggcttaacgatcggtgaatggacggaaaacggtaaagtcggcatcaacttagaagggcacggccgggaagaaatcataccgaatgtcaatatttcacgtacggtcggctggtttacggcccaatatcctctgattctgcaggtcagcaaggaggacggcgtctcctctgtcattaaaacggtaaaagagacggtgaggcgcgttcctgataaaggcgtcggctacggaattcttcgatatctgtcaccagatgaaacagaaagaagtttcacgccagaaatcagttttaactacttagggcagtttgacaatgaggtgaaaaccgaatggtttgagccgtctccatatgatatgggacgtcaggtcagcgaagagtcagaagcgttatacgcattgagcttcagcggtatgatcaccggcggccgcttcgtcatttcctgctcatacaatcaggaggaatatgaaagaagcaccgttgaaacacagatagaacggtttaaagacaatctcttaatgatcatccgccattgcacggccaaagaggagaaagaatttacgccgagcgatttcagcgcgaaggatcttgagatggatgaaatgggagacatctttgacatgcttgaggagaatttaacgtgataaaaacagataacagaaggggggagcggagcagatgagccaattcagcaaggatcaagttcaggatatgtattatttgtcgccgatgcaggagggaatgctgtttcatactctcctgaatcccggccaaagcttttacatcgaacaaatgacaatgaaagtaaaaggtgatttttccgtcaggatgctggaagaaagcatgaacgtcattgtggaccggtacgatatatttcgtaccgtgttcatccatgaaaaagtcaaacgcccggtgcaggtcgtcctgaaaaaaagaacttttcacattgacgaaatcgatctgacacatctttctgaaagcgaacagatgaccgccatcaatgagtataaagagaaagataaggtgaaaggattccagctgacccgtgacattccgatgcgtgccgccgtcttcaaaaaagcggataagcgctatgaatgggtatggagctatcaccatattctgcttgacggctggtgcttcggcgtcgtcgttcaagacttatttcaagtttataatgctttaagagaaaacaagccttacagtttaaaaccggtcaagccttataaagagtatattaaatggctcgaaaaacaggacaagcaggcatcgctcagctactggggcggctatttggcggatttcgagggtcagacgacgttcgctgagcaaaggaacaaacagaaagccgcttatcagccgaaggaactgcttttctccctgcccgaagcggaaacaaaagcgttcacggagctcgccaaatcacagcatacgactctcagtacggcgcttcaagccgtctggagcctgatactgggccgctatcagcgctcggatgatgtcatgttcggtacagttgtgtccggacgtcccgcggatattaaaggcgttgagcatatggtcggactgtttatcaatgttgtgccgaagcgggtccgcctcactgacggcatgaatttcaaagatttgctcagacatcttcaggagcagtcgctggagtcagagccgcatcaatatgtcccgctttatgacatacaaagccaggcttcccagcagaaactgattgaccatatcatcgtctttgaaaactatccgcttcaagacgccgacagcaaagaagcacggcagaacgggtttgaaatggaagatgtccacgtctttgaaaaatcaaactacgatctgaatgtcatggcgtcgccgggtgaacaaatgctgatcaagctggcttacaacgaaagtgtttttgacgaagcgtttatcagcaggctgaaatcgcaattgctgacagccgtcagctatatcgtacagcatccggaagcgccccttcatacggtgaatatcatagatgaggccgaagagaaacgccttgtcacagaccttaatccatcccgtctgtctgccgaggcgaaaaaactgacggattggttccgtcaggcggctgaagcaaatcctgacgcgccggcagtaacagccggagaaacaacgctgacttaccgggaacttcatgaagaatcaaaccgtctcgcgcaccgtttacaaaaacaaggaatcggaaaaggatcagtagccgctttgtttgtaaagcgttcttgtgagatggccgcaggaattctcggcattttaaaagcgggcgcggcatacctgccgatcgatccggagtacccggaggaccggatcgcctacatgcttgaagacagcaaagccggttgcatcgtgacgcatcaagcgctgtatgcggaagctgagaagctgccgtatgcgggaagcctgatgtgcattgacggagaagacgggcttgatgccccttctgatgaaccggaagcatccggcggcgccgatatgccggcatatatcatgtacacgtcaggaacaacgggcaaaccgaagggcaatgtgaccacacatgccaatattcaaagaatcgccaaaaacacaaactatatcagcatatccgaaacggatacggtgctctctctttccaactatgcctttgacggtttcaccttcgatttttacggatcgcttttaaacggagcaaggctcgtcattgcggataaggagaccattttgaatactgaaaagctgactgagctgatcgtttcagaaggcatcaccgtcatgtttgtcacaaccgcgctgtttaatgtgctgacagacgcgggtggcgagtggatgaaagggcttcggcatatcctatttggcggagaacgcgcttccgcggcccatgtcagaaaagcgctccgcatcatggggccgggcagactcattcacgtgtacgggccgactgaagtgaccgtgttcgcaacggctcataccattcatgacattcctgaatccatgtctgctgtcccgatcggcaggccgctgaatgaaacgggcgcttacattctcacggaaacagggcggctgcagccattcggagcggtcggtgaattgacgctgaccggaatgggtgtgtcaaacggctatctcaaccgggaagatttgacgaagcaaaaattcatcccgaatccattcaagtccggtgagcgcctataccgcacgggcgatttggcgcgctggctcccggacggcacgattgaatttgccggccgtattgacgatcaagtcaaaatccgcggacaccgtattgaacttgaagaaattgaaaagcagatccaagcgtatcaaggtgttaaagaagctgttgcagccgtcagccgcaatgaatcgggagacgcttacattgatgcatacctcgtatgcagcgctgaaattgacacgaacgggcttgaagtctttttaagcagacagcttccggcatacatggtgccgcaatcgttcacgatccttgagaaactcccgctcacgccaaacggcaaggtgaacaaacgcctgctgccgaaagcagagccgaagcagcggacaggcaaagaccagacgccgccgcgcaacgaaacggaagaacgcatcgcccgcatttgggccgaggtgctcggaacagaatcaatcgggattcatgatgacttctttgcgctcggaggccattctttaaaagcgatgaccgcggcgtcacacattaaaaaagagctcggtacggacattccggtgaagctgttattcgaagcgccgacaattgcgggcattgccgattttctgcttcacggtgaagaaaaaggaatgaaagatctcacaatcatgaataaaaatcagtctgacacactgtttgcgttcccgccggttctcggttacgggctgatgtaccagccgctcgcaaaacagctgtccggctgcagaatctgtgccttcgattttatcgaggaagacaaccgtatcgaccgctacactgaactgatcaatcagcttcagccggaaggggccatcaagctgttcggatactcggcaggctgcacgctcgcctttgaaaccgccaaacggcttgaagccgaaggccgtgaagtggagcggctgatcatggtggactcctataaaaaacaaggcgtcagtgacttggatggccgcaccgtagaaagtgatgtccaggcgctgatgaaggtgaaccgggacaatgaagcgctgaataacgaagccgtcaaagaagggctcgccaaaaaaacaaacgcattttattcttatttcgtacacaccgtcagcaccggcacggtcaacgcggatatagatcttttaacatcagaaccggactttgcgatgccgccgtggctcgcttcgtgggaggaagccacgacaggtgaataccgtgtgaaaaaaggctgcggcactcacgcagaaatgcttcagggagaatgtctcgaaaggaatgcggcacatttgctcgaattcctaaggaatgaacatctgaagctgacaacttcacgatagaaaaggaggaagccgctaatggtccagctctttaaatcgttcgatacgacagaaaaaacgcagctcatctgttttccgttcgcaggaggctattccgcatcattccgcccgctccacacctatcttcagggtgagtgtgagatgctagccgcggaaccgccgggacacggcacaaatcaaatgtccgccgttgaagattttgagcagctcgtcagcttgtacaagcaggagttgaatctcagtcctgaccgcccgtttgtgctgttcggccacagtatgggaggcatggtcgctttcaggctggcgcaaaagctggagcgggaaggcatttacccgcaggccgtgatcatctcagccatccagccgccgcatgcggaaaggaaaaaagtttctcatcttgatgatgaaaaatttctcgcccatattatcgagcttggcggaatgccgcaggagttagtggaaaataaggaggtcatgtcatttttcctgccttctttcagatccgactaccgcgcgcttgaaagcttccgcccgtctgattctcacatcattcaatcacccgtccatatttttaatgggcggaaggatcataaatgtatcagagatgcggacggttggaaaaaatgggccgcaaatcccgtttttcatgagttttcggacggccacatgttcatattaagtgaaactgaacatgtggcggaacgaatttatgagattattaacaggagcactgcaggccaattgttataaaatatgacagacagcatccgctgtctgttttttgtaacaaaatcggccttggagttttctcatttatcaaaaattttatgttatgatttaatggaatatcactttgaagggattgtcgtacatgaatgatgcagctaaagagctgaacagaacattatctgaagaaaacccgcacgtgcttcatatgctttctgatttgggcaaagatttgttttatccgaaaggggtgctgacgcaatcggcggaagcgaaagccaaggccggaaagtataatgccacaatcggaatcgccacctcacaaggagagtccatgcacttttcccatatacaagagacattgtccgcctataaccccgatgatatctacgattatgctccgccgcagggaaaagagccgctcagacaggaatggctgaaaaaaatgcgtctcgaaaatccttcattagccggcaaagacatcagcacgccgatcgtgacaaacgctttgacacacgggctgagcattgccgccgacttgttcgtcaatgaaggggatacgctgcttctgcctgataaatattggggaaattacaacttcattttcggtgtccggcgcaaggcatctattgagacgtacccgctttttcagcaggatgggcgttttaatgcggctggtctgtccgagctgctgaaaaagcaggaagagaaggcgattgtcgtgctgaatttcccgaataatccgacaggctatacgccgggggaagaggaagcgttagaaatcgtcagcgtgattctggaggcagcggaggctggcaaagagattgtcgtactcgtagacgatgcgtattacaatttgttttacgatgaaacggccattcaggaatccatcttcagcaaactcgcccaagtgcatgacagggtgctttgcgtgaaaatagacggagccacaaaggaaaattacgcatgggggttccgcgtcggttttattacgtacagcgcaaaaagcgaaaaagcgctgcgcgtgcttgaggaaaaaacaaaagggattatcaggggaacgatttcaagcgccccgcatccgtcccaaacattcatgctgcgggcgatgcagtcaccggaatacgagaaagaaaaatcactgaaatacaacatcatgaaaaaacgggctgacaaagtgaaagccgttcttgcaaaaaacaagcactatgaagacgtatggacgccttatccgtttaactcaggctatttcatgtgtgtccggctgaaagatataaacgccggcgaattgagagtgtcattgcttgaaaagagagggatcggtacgatatccattaatgaaacggatttgcgaatcgcgttttcatgcgttgaagaagaacatatcgcggatttgtttgaagaaatttatcaagaagcaaagcagctgcagaaacaggcggaaatatcaggctgacaaaaaaggaggggggcacccctcctttttctatgcttacagcagttcttcatacgttttcatctcaatcccgtcacaaaaatcgggatgagccgcacaaaccgccagcttatattcttcgtccgcatcatatgtgcggatgaaacatggttcatgtccgtccgggagttcaatggacacacaaccgtcctcttcaaggcggacgctgaatgaatcaagcggcagggaaagcccttttccggcctgtttgataaagctttctttcattgaccacaggtgataaaaataatcggtctgccgatcgggatgtttcgcttgcagatcactgtattctgaaggcgagaaaaaacgtttcgctatatcaatcgtgccgggcttcattttttcaatatcgatgccgatcggttttgagtcaacggcacacacgatccagcgcccggagtgggaaatattaaagtgcaagtccggaagcgcggggatgtacggctttccgtactcctggacgctgaatacaatcgcagccggattaagtccgtaagccctccccgcaatggtgcggatgagcatgtcgcccagcaaggtgcggtgagcatcctctttatgataaaagcgccggcatttttcccgcttttcagcggacacagccgccatcatccgatcctcttcccttggagaaagcgggcggtccatatatactccgtaaatcttcatgtccagatcctccgtctgcaaatattgtcaaaaccatcctatcatatcagacgcaagctgtccggcaataaaaaaaacaaaaccgtgtcggctttgttcttaatgaacggacgctgcccgcccgtagatcgcatatgttaacagtttagaggactgaggcaaagaaaaacgcagaatcagcccggtcaaaacagccgtaataatggttccggctccgatcggtccgcccatcgtccaggctgcggcaagaatcgtcagttcaatgccgttccgcacccattgcacgttccagcccgttttttcagaaatcagcagcatcagagagtcccgggggcccgcgccgagcccggccgatacgtaaataccgacgccgcagccgatcagcagcaatccgaaagaaaaaaacacggccgctaaggaaaaagcgtgcgcttcaggaagcagaaatgaaaaaaaatcaataaacattcccatcatcagcatattcaagatggcgccgattttcgggagcgttctcgtgaacaggcaggttaaagcgacgatcaccgcgccgaccacgatggaccattgcccgacggaaagaccgaaatgctgaaaaagcccataatgaaaggcatcccaagggctgatgccgagagcttttcctttaatggttaaagataccccgaaagacaaaatcaacagaccggcaaaataaaacgtccagcgcatcacgaattcccgcttcaaagaggtcccttctttcataaaatctcattaattgtcattgtagcataactgccaaaaaaaagaagagcgaaatcagtgtttcgcttcttcttcggctcctacaaaggattcagtatacgattcaaaaaccgctgcgtgcgttcttctttcggcgcggaaaaaatttgggccggtggtccttgttccacaatgacgccgccgtcaatgaagatgacttcatcggccacttcctgcgcgaatttgatttcatgcgtgacgacaaccatcgtccagccttcattcgccaaatccttaataactttgagcacctcgccgaccagctccgggtcaagcgctgacgtcggttcgtcaaacagcatcagctcaggctgaatcgcaagcgcgcgggcgatgccgacacgctgctgctgaccgccggaaagctggaacggatataaattcattttgtctttcagtccgactttttcaagaagctcaatcgcttcttttctgacttgctctttgtcgcgcttttgcacttgaatgggtccttccataacgttctcaagcgccgtgcggtgaggaaacagatgatacgcctgaaagaccatgcctgatttgcggcggaggcgaaggatatcagcctgcttcacttttttggagaaatctattgaaaaatcggagaatgccagctcgccgtgattgggaatctcaagcgcgttcagacagcgcagtagcgtcgtttttcctgaaccggacggtcccagaacggcgatgactttccctttttctatctccatatctatcttttttaaaatttcattctggccgaatgatttatttaatcctttaacagaaagcatatcgaaacctccttatttggccacataacggtcgagacgccgttcgatcacaagctgtacgattgacagcaagaagcagatgatccaataaataaaggcggcttcaatatagatgaccaagatctgatcaaggttttgcgcgccgatttcctgcgctttcctgaacagctccgcgacgagaatttgtgacgcgagagatgtatccttgatcaggctgataaatgtatttgataatggcggaatggacacgcgaaacgcctgcggcaggatcacgcggaacaatgtcttgcgataggtcatgccgatcgtataaccggcttcccattgccctttcggcacggatgaaatagatgcccgaatgatttcagaagcataggcgcctacgtttagtgaaaatgcgatgacagcgcttgggaaagggtccagtgtaatattaaaggtcgggaacagataaaaaatgatgaacaattgaacgagaagaggagtgccgcgcaccgctgatacatatacgctgaacacccatctcaatggtttcatatttgacattctggcgagcgccgtaatcagcgcgatgatcattccgaaaataaaggaaagaatggtaaggggaatcgagtaatagattcccccggaaagaatcggccagaatgactgctgcaccagatcccatggaatggctgccgcaatcacgggctcaggcatgttacttagaaacatcttcgccgaaccattttttagctattttagaaagagtcccgtcctctttcatttcttttaacgctttgttgacgtgagtcacaagttcgccgcttccttttcggaatgcgaaataagtttgttgcggctgcccagcttcaaacgcgattttcacgtttttattgccggacgtttttaagtagttcagtacggcaagcttatcgttgtaagtcagatcagcgcggccctgctgaatgagctgaagggattgcgccatgccttcaacgccttcaattttcgcgccggcttctttcgctaatttattgtaattgcttgttaatgactgagccgcggtttttcctttgacatcagcttcttttgcaatcgtgctgtcttttttcgtcacgacgacggcatttgacgttgtgtatttatcagaaaaatcatattggttctcacggcctgttttgccgacttggttagcgacgacgtcaaaccgtttagcatttaatccggcaaacatgctgtcccattgcgtttctttgaagtcagctttcagaccgaggcgtttcgcgacttcttgaatgacctcaacatcatatccggtcagtttgtcagtctttttatcatggaaggtaaatggttcatacgttccttctgtaccgacggtcagtacgccttttttcttgacagaagcccaaagatcgccgtcttttgacttcgatccgctgtcctgtgagtttccgcaggctgcaagcaccgcgatgctgaccatcatgaataaagccaataatgcttttttcattttctttattccccacttttctgattagttttattgagaaaaaatagctcccaattgtaaaggataacttttttttagtatgagtcaagtaattggttttcatgagtgtgaaatctccgtgtttccgggggtcaaaataattgcaaaaactgtctgaccggcttcggcaggtagctgtcttttctccagatgacggccggtgtcatgacaaacgggttgtcctcgatggcgaccgttttgacatgcgatcgcatatggacgggaatcatcgtcaaaggcagaatcgtggctccgaacccagatgagacgaggctcaaaagtgtcgcggagtcatggcattcacagacaacctgaaggtcgagaccgtactgttcacaaacatggaggacttggtcatacacaccccttccattgacggtgcgcaaaaggatcagaggcaaagaagcgatgtccttcagcttaatcgtttttccgcacaggcgttttgtatgctcagacagcaccaatacacacggaatgtcttcaagctcctttgattcaatgccgtcgctcttaatcaaggtggtggtgacggcggcgtcaatctgtcgggattctaagagctccagcagtgagacgggttcgtcttcccaaatgttaaaggtgagatgaggataccgctctttcatctgcgacactttctcaagcatgagtgcggcgcagtaaatggttgaccccacggcaagggggccggctgcttcttccttcagctcttgtacctcgataatggcgtcctcaaacttatgaagaatctctttcgctcttttcaaaaatacgtttccttcatatgtaagggtcatttgtttctttttattgcggtcaaacagaatgacgcccaattcttcttcgagctgtttcagctgtctgcttaacggcggctgagccatatgaagctttttggcggccgtcgtaattttctgctcttgggcaatggtgacgaaataacgcaattgccggatatccatgagaatgcgctcctttcttttatacctttagggtatgatatatagatttaacgaatatttttcatatggatatatcaggagtatgatggttttgacaccatatttcaagcgtaaaggagggttcaatatgaaactcgtcatcggaatgaccggggctacgggagccatattcgggatcaggcttttagaatatttaaaggccgcggagatcgaaacccatcttgtcgtttctccttgggcaaatgtcaccatcacacatgaaaccgattatacgttaaaagatgtagagaaactggcgtcctatacgtattctcacaaagaccaggcagcggcgatttcaagcggctcgtttgaaacggatgggatgatcatcgctccgtgcagcatgaaatcacttgcaagcatccgcaccggaatggctgacaatctgctgacaagagcggctgacgtcatcctgaaagagcggaaaaaacttgtgcttctgaccagagaaacgccgctcagccaaatccatttagagaatatgctagcgcttacaaaaatgggttccgtcattcttccgccgatgccggctttttacaacaaaccggctgacatggacgaattgatcgaccacattgtgttccggacgctcgaccagttcggcatccgtctgccggaagcgaaacggtggtacggaattgaaaaacaaaaaggaggaatctgataatggcctatcaggattttagggaatttctcgccgctcttgaaaaagaagggcagctgttaacagtcaacgaagaggtaaaaccggagccggatctgggcgccgccgcgcgtgcagccagcaacctcggggataaaagccccgcacttttgtttaacaatatttacggacaacatcatgcgcaggtcgccttgaatgtcatcggctcctggccgaatcacgcgatgatgctgggcatgccgaaagatacgcctgtaaaagaacaattctttgagttcgccaaacggtacgattcatttccggtatcggtcaaacgggaagaaactgcgccgtttcatgaaaatgaaataacggaagacatcaatctttttgacatccttccgttattcagaatcaaccagggagacggcggctattatttggataaagcgtgcgtcatttcccgcgatcttgaagacccggacaatttcggcaagcagaatgtcggcatttacagaatgcaggtgaagggaaaagaccgcctcggcatccagcccgtgcctcagcatgatattgcgattcatcttcgccaggctgaagaacggggcgtgaatcttcccgttacgatcgcgctgggctgtgagccggtgattacgacggccgcgtcaactccgctgttatacgatcaatccgagtatgaaatggccggagcgattcaaggggagccttacagaatcgtcaaatccaagctgtccgacttagacatcccgtggggcgccgaagtcgttctggaaggagagattctcgcgggagaacgggaatacgaaggcccttttggtgagttcacgggtcattattcaggcggccgcagcatgccggtgatcaaaatcaaacgtgtatatcatagaaacaatccgatttttgaacatttgtacttaggcatgccgtggacggagtgcgactatatgatcggcattaatacatgtgtgcctctttaccagcagctgaaggaagcatatccgaacgaaatcgtcgccgtcaatgccatgtatacgcacggtctgatcgccatcatttcaacgaaaacacgatacggcggctttgctaaggcggtcggcatgcgcgccctgacaacaccgcacggactcggctactgcaaaatggtcattgtcgtggatgaggatgtcgatccgtttaatctgccgcaagtcatgtgggcgctttcaacgaaaatgcatccgaaacacgacgcagtcattattcctgacctgtccgttcttccgcttgacccggggtctgatccggcagggatgacacacaaaatgattcttgacgccacaacgcctgccgcgccggaaacaagaggccattattcgcagccgcttgattctccgctgacaacaaaagagtgggaacaaaaactgatggacttaatgaatcaataagaaaggatgagtttgcaatgaaaacatgcccgcgctgtgaatcgaaaaaaggagaaaccgtcagccaatcgccggtcaaaggcgcttgggaaatataccaatgccaaacctgcttttttacatggagatcctgtgaaccggaaagcatcacgaatccggaaacattcaacccggcatttaaaattgatccgaaagaaacggagacggccactcaagttcccgctgttccggaaagaaaagcgtaatgctgacggagcatttgccggaagccctttacacgcttttagacgggacggagcttgagaaaaagcagcacgatgcatttgtactgcaatccgtgacaaaacaaggccgtccgcacgcggccatgatcagcgccggtgagattctggccgtgagcagcacaaatctccggatcgccttatggaaaaacacgacgactgtaaaaagcctgctgcattcgggacaagctcttttcatcgcctggcacggaggagctgcctattacgtcacattggaatgtgaggcgcttccgccgctgaaagaggcgaaatacgagcgggaacggttcagctgccgcgtgatttccgtcaaggaagatcgggcgaaatacgctgatctgacgtccggcccggccattcagcttcacgagccggaaagtgtcctgaagagatggagcgaaacgcttgaggagttaaaacaataaacgcacaaaaaaagcctgcggacgcttccgcaggcttttctattattgtacgcctttcatcgcccgtttaataacgggagaaagaagaaccaaaataataccgagaatgatggaaataagcccgattgagccgaaataggccgcttcagaaatcttatcaaacaaaccgactacttttgcgttcagggcttggccgcaggcgtttgttaagaaccacatactcattgtctgcgctgagaaagcggcaggcgcaagcttcgttgtgacagataaaccgaccggtgaaaggcaaagctcaccaagcacaaccaaaaggaagctgagcacaagccaaagcgggctcacaagctcgccgcttccgcccataaccggaagcaccatgactaaaaatgacaatccggcaaggataatgccgatcgcgaatttaatcggtgttgaaggctggcgtttgccgagcttcatccagaaccaagcgaacaccggcgcgaaaataacgatgaataatgggttcagagactggaaccatgaagactcaagatgcattcccgcaaaagaaagcctcgtgcgctgatccgcatataaagcaagaatcgtcgcaccctgttcctgaatagcccagaacatggccgccgcaataaacagcggaatataagccgcaagccgtgatttttccgttcttgtcgcttttttgcttgtgaacatcacgataaagtagataaccggaatgacaatgccgaggacactgacgacgtcaattacacgctggattgtcagccagccggtttggatgagaacgaaaataacggcggctgcgatgaccactccgattcccgttccgatcactgatgatttagaaatcggattcggtacattggagcctgctttgccgaggtatttctttctcgtaagagcgaaaacaatcagtccgaggaacataccggccgcggcgcatccgaagcctaagtggtagttgtacttctgtccgagtgttccgacaattagcggcgcaactaatccgccgaggttgatccccatgtaaaagatactgaaaccagagtcgcggcgctcgtcttccttcgtatatagatctccgacaacgctggatacgttcggtttaagcaggccggttccgataatgatcagagccatgctgagaaaaaacgccgccgtgctgccagggaaggcaagagcgatgtggccgaacataattaaaattccgccgtagaatacggtgtttgccgtaccgaatacccggtcggccagccatccgccgatgacgctcgacatgtatacgagagatccgtatatggacatgatggcaactgcggtgcttttatcaaagccgagaccgccatgagcgacttccgtgtataaatagtaaagcaatatagctctcataccatagtaggagaaacgctcccaaaattcggtgaaaaacagtgtgaacaagccgcggggatgaccgaaaaagcctcgttgcggcacagtttctgttatagcttccttttcaatagatgccacctgagccaaccctttcttaaaaaagtgtattacaaaaatcatattcttatataatacttgtgtcaatataatttatactgaattcaaaaaattccagaatgaaaagatattataacgaagaatatagacgtattttcctaattccaatgacttatttttggtatattatctaactaaactatctttataaacttttttaataaaatttaaagtatgtacaggcggagcgggatatggcggaataagatggcaataagagagaaaggaggagatcatcacttgccgaatcgtatattggatataacggattgcggcgtggcggcagacgggaaaaccgacgtgacaagcgccatcaaccaatgtttggccaaagccgtcagcgagggctgtcatacggtgttttttccgtccggaacgtataaaatcaacggcacgcttggcggtgacagcggccagccgtttaggaacgccggaattaatgtgccgagccatctctccatcgtcatggatccggaatgcacgattaaagtaacgccgaacagctcctggggctactcggctttctatataggcaggcgggaaaatgtcaccatcaccgggggccgcatcatcggggatcgggatgaacacaagtatatcaatgttcctttgcggtcgacccatgaatggggattcggaatctgtattgaaggcagcagcaatgtactgatcgaagatgtggagatatcggattttacgggagacggcattattgtcagtccgctcgggttaaaaacaaacagtgattacgaaacatcagaacatataaccatccgccgctgcgatatcagacagtcaagacgcaacaacatttcaatcaccggctgcaacaccgtcacggtggaagactgcgtgattgaagacgccgggaaaggaaatggaacagccccgaaattcggaatcgatattgaatcgtacggagaaggcgatgttgattatgaagaggctcttcatattacgatccgcaacaacttcttttacggaaacaccgcaagctcagtcaccaactttaacggatataacgtgttaattgaaggaaatcattccgacaatacaatcagttacgggtacggcgcgcataccgtcatttcagggaacgtcctcttttggtcaaacggcggctcaagaaccggaatcgccggacaaggtgtgtcacaagggcaggacagcagcaatgccgtcatttccagcaatctgattaccggtttttccaccgggatagatgtaagggggaaaagcgtcctcgttacccacaacaaaatcaatcaatttgaaaatacgggcatttccgtctatcgggcggaagatgtgaccgttgacggcaatgtcattgaaaacgggcgttccgaaacgggacgaagcgcgggaatgcgggccacgctttctgaaaacgccgtctttatgaataacactttgaatcaggtaacagacggaatcagcatatcagccggcaatatcaccgtaaaacagaatgtgctgaaatcgttcagccggggcatatgggtcacaggcggaaatgccctcattgaaggaaatacgctcatccctaatgcgtttcagggcgccgcagagtcctatgccgtatctgtgacaaacgacgccaaggctgtcatcaaaggcaatctcttcaaaagctacaaaaactatcccattttcagttcgacatcctcaggaacctctgtcatcggcaaccgctttgaatcatcaccgcttatcgttaccgtgtatctgaactcaggaacgcatgaagtcatagacaataccatcacgatcaaccgaacggcgggcagcccgatcggcatctatctgaacggaacctccaattccctcgtttcggggaataccatcaacaacctttccgccgcttctgcttcggctatccaaaccagttcctccgcaagcacgaaaatcatcggcaaccgcattatcaaaggcatcattgtaaaacacactacagatacggaaatcggaaatatcgtcatctgatcatcattaccgtctgaacaataaaaagaacacatgaactccgaaaaaaggagcgatgtgttcttttttgacacaatacagctttcaacagcagtgacgaagtgccgggcgcttgtcaggcatctttttttcctgttttatataaagccaacatttctttgattaaaaagagggcgaagaaaaacagcatcagccattctgagaaggtcatcaatttaaaagcggacaggttgttttgaaccgctccatagagactgaaaccttgcagcatatccacccctacagaaatcatcagacaggaagtcagtaaaaaaatggaaatccccaatattttcatgcggtatcactctccctttttatccttttcaaatttgcaaaacttatacagactttccgccgtgcataatcttttgccgtacaggaagaatatgaaaaaaacgaggaaaggttttttgcgatatgccgccattttttaagcagaagaaacaaaaaaaagccgatcaaaacgaccgtggcaatgaagacagaaaagaaccggaaaacaaatcagacaaagagcgggaggagccgatctccctcagcttagagaaaaatatgaagaagctgtctgcgaggttcggcaacagtgctgatgtcgttatccgccggctgaaaatcggaaaggaagagcttccggccgcgattgtgtatatcgccggtttggtagacgaacagcttgtcagccaatctcttctggaagatttaatcgatattccgtccgttcagccggaacaagcggtctgcctgatatacgaaaaaacgcttgcgatcggcggagtaaaagaggaagagaaatggaaaagcctttttgccgggctggtggcgggcagcacgctcatttttgtcgacggggctgacaaggcgctgatcgccagtacggaaggaggggaacaccggtccattcaagagccgagcactcaggtgtccttccgcggcccgcggcagggattcacagaatctctgcaaaccaatatttccatgatccgcaggtatgtaaaaacgcctgatgtatgggttgaaaaaatggagatcggacacgagacgaatacggacgtcgcgctgatgtatatcaacggaatttgtgaaaaaaagctgattaaggaagtccgcaagcggctgaagcacattgatatcgacagcattctggaatccggctacattgagcagcttatagaagacgcgccgttttccgtgtttcccactgtgtatcatacggaacgtccggacgttgttgcgggaaatctgctggaaggaagatttgcgattatcgtggatggaacgccgtttgttctcctcgcaccggccttatttattcaattttttcaatcagttgaggattattattcacgatttgatatcgctacaagcatcaggctgcttcgggttttgatattcttcatttcactggtggcgccggggatttatgtggcggcggcgacctttcatcaggaaatgattccgacgcagctgctgattgtcatcgccgcccagcgggagacggtcccgtttccggccgtcattgaagcgctgacgatggaagtggccttcgagattctcagggaggcgggcgtccgtcttccgagagttgcgggttccgccgtttctatagttggagcgctcgtcatcggccaggccgccgtacaggccggcatcgtttccccggccatggttatcgtcgtcgcgctgacggcgattgccagctttgcgaccccggcttttgacatggcgatatctgcgcgcctgatccggtttgtctttattctgtcggcggcggtgatgggattttacgggctgattctgggcattatcatgatgtttgttcatctgtgcagcctgcgttcattcggttttccgtatatgtccccgctcgctcctttgtccccgggcgggctgaaggattcccttctccgcgctccgctgtgggcggatgaaaaaaggccgggactgctcgtgcagaaaaacaacaggcgccaaggagaacatcaaagaccgaaaccggagacatccagaggaatggttaataaagatatagaagagggcgacggtaatgaaaagacgtaaatggatactcctcctttgtacgatggtttccctcatgtttgtatccgggtgctgggataaaagagagctgaccgatttggcggtgatctccgccatcggtattgaccggaccgaatcgggaaaatacgtctttcactttcaaattatcaacccgggaaacgtggccggcggtctgcagggcggcggagcgggagaccggcctccggtttccgtctattccgtgtccggagacaatatgacggaagctttgagaaaaggctcgatgaaggtgtccagaaggctctattttgcgcatacgaatcttgtggtgttcagtgaaaagctggcgaaagaggaagggctcagttttattctggacaatcttgaccgcgacaccgaattcaggacgaccgcaaccgcggtcattgcgcataattgcaaggctgaagacattattaaagtgctgacgccgattgataaaatcccttccaataaagtgaacaagacgctcagctttacgcaggaacaatacggcagagtcattaaaacaagccttcaggacgttctgattgatctcgcctctccgaccgggtcgccgtttataccgggttatgaaatgcacggagacgataaagtcggtcctacgatggaaaatacgcagacgactgaaccgaaagcgctgctgtcagctgacggattggctgtgttcaaaaaggatgggagactcgattactggatcgaggatgacgacagtgtgggcgcggtatggctgctgaacaaaatcaagcatacgttcatcaatgcggattggaagaacgttaagcatgcaatcagtctgcaggtcacccgccagaatacgaaggtgacggccacttttccgggcgggaaaccgcatattcacgttcatgctgaggtcgaaggactggtggacgccgtcagataccctttccatctgtctgatccgaaagtgctgatgaccatgcaaaaggcgctcagcgcgcagcttgacaaagatatcaccaaatctattgaagatattaaggctcataagaatgatttcatcggcttcggagacctgatttatcggcagcatccgcataaatggaaaaagttaaaagggaagtgggatgaagaaatctttcctaatctccccgtggatgtaaaaacggaagtcatcatcagaagaacgggcttgcggaataatcctctttcagacgagctccagcatgattgatttgaggagaaaggagcaaagcacatggaaaatgccaaaatcggcacgcgtcagctgtttattatgatcattttgtttgaattgggcagttcgttattgatcccgccgggcacgatggccggacgggatgcatggctgtccgtgcttctcgggtgcgttgtcggtctcggacttttctacgtttatcaggcgctgtatcagtattttcctgagtcttctccgagagattacatgaacgaactgatcggcaggcatctgagctgggtggtctttcttctctatattctctattttgcttatatcgccgcccgtgtattgagggattttggcgaaatgcttgtcaccttcgcctatcaggacacaccgcttgtcattgtgaatgccatgctgatgattgctgcgatatttgcggtcagaaagggaattgaagtcatagcgagagccggcgagctgctgtttggcattatgtatttcctgacggccatcgggctgatcctccttatcagctccggcacgataaacctcagatttctccagcctgtcttagcggaaggcatggggacagtcatttattccgtgtttaaacagaccatgttcatcccgttcggtgaattaatcgtgtttgtcatgattttcccttacttaaaagatcggaaaaaagtgaagaaaacaggatttctggcgattatcatcagcggtctgtttttggcgatgtcggtggcgattaatatttgtgtgctggacgtcaacttaatgctccgctctcaattcccgctgctgagcaccatacagacgattaaagtggaagagtttttagaccggctggatgtcttttttatgctcgtgctcgtcatcggcggttttttcaaagtcagtctttttacatattcggttgtcgtgggggtctccacgctgtttaaagagaaaaatccgtcccagctggccttgccggtcggattgggagtactgattctctccatcagcatcgcaagcaatttttcggaacacatgaatgaaggcttaaaaattgtgccgatctatattcatcttccgtttcaagtgctgttccccgttttgctgcttatcattgccgtgatcaagaaaaaagtcaaagggagcgtctatacagtttcgaagaaataacccggccgatgcgccgggttatttttaaaatcatgatttttgtctgaatgcattgacaaacttgcctgacaattgtacattttgatttattcttataaatttactaggaaatataggtttagtagtgttaatattttccgaacggtatttcagaatagaaggagatacgtcatgacaaagaaaaaagaaatcaaactcggtgtgtttctcgcgggcaccggccatcatgtcgcctcttggagacatcctgaggctccggcggacgcgagcatgaatttagattatttcaaagaactggccaaaacagcggagcgggggaaattggacatgctgtttttagcggacagtttatcaatagacagcaaatcacatccgaatgtgttaacgcgttttgagccgtttacgctgctgtcggcgctcgctcaggtcacatcccgcatcggtctgacggcgaccgcttccactacatacagtgaaccgttccacatcgcgagacaaattgcatcgcttgatcatctttccaacggccgcgcgggctggaatgtcgtcacatcatcaattgaatcaaccgcgcttaatttcagcggcgaaaagcatcttgagcaccatctcagatatcagcgcgcggaagaattcgttgaagtcgtcaaaggattatgggattcgtgggaggaagacgcctttatccgcgacaaagaatcagggacgttttttgataaagacaaaatgcatgaattgaatcataaaggaacatatttttccgtaagagggccgttaaatgccgcccgcactccgcagggccgccccgtcatcattcaggcgggatcatcaggagacggaaaggcgctggccgccaaaacggcggaggtcatttttaccgcgcaaaaccatttggaatctgcgcaggaattctatcattctattaaagaacaagcggcttctttcggccgtgatcctgaaaaaatcgcgatcatgccggggatttttcccgtgattgccgatactgaggaagaagcgcaggcaaaatatgaggagctccaagacctcatcatcccgtctgtcggcctgaacattctgcaaaactatttgggcggcgtcgacctttccgcttacccgcttgacggcccgctgcctgaattggatgcggaagcgtcaaatgccgtgaaaagccgcttcaagctcgttcaagagatggccaagcgcgataacatgaccatccgcgagctgtacaaatatgtggcgggttcaagaggtcatcatatctttgtcggaacgcctgaacagcttgccgataagatggaagaatgggtcgacaaacaagcttgtgacggcttcaacatcatgccgccgcttttgcctgaaggtctcactctttttgtagataaagtgattccgattttacaagaacggggcgtgttcagaaaagaatatgaaggaacgacgctgagagaacatttcggactggaaaaaccggcaaaccgatatgccggctaaggagggctcatcatgtcaagacaataccggctcgcaacggaaagagacgctgatgaactgctttcactgacactgcgggcgtatgaaccgatccggaagctcggcataaactttgccgcagcaacggcggataaagagctcgttttgaataacatccaaaaaaacgcctgttacgttttggaggaagacggacggattctggcgacgatttccctgcggatgccgtgggggccgaatccagggccgtacggtgtccctcatatttggtggttcgccgtcgaccctgacaccggaaaaaaagggacgggctcagaaatgctggagtggctggagaacacggtgcttcgcgatactttaaaagcccccttcgtatcattgggtacagcagacaagcatccgtggctgatcggcatgtacgagcggaaaggctacgtccgtgcaggcgaaaaggatttaggaaaaggacacatcaccatctatttaaaaaaacaattgcagaattaacatattcatagaaaaaggcgggagttcaatgaaaaagaaaacatgggctttgctgctgtttgccgcgcttttggcggtcttatcagcatgcggtaacggaaaagaaagcgaagacggaggtaacgtgctgcatgtcggcgccacgggacaaagctatccgttcgcatataaagaaaacggcaagctgaccggctttgacgtggatgtcatggaagccgtagcgaaaaaaatcaacatgaagctggactggaagctgcttgaattcagcggactgatgggcgagctccagaccggcaaactcgacactatctcaaaccaggtcgctgtcacgggtgaacgcaagaaaacgtataactttacagaaccgtattcctatgcgggcactcaaattgtcgtcaaaaacgataacaaagacatcaaatcagtcaatgatctaaaaggaaaaacagtggcggccgttctgggctcaaaccacgcgaaaaaccttgagagcaaggacccggataaaaaaatcaacattaaaacgtatgaaacacaagaaggtacgctgaaagacgtggcttacggacgcgttgacgcttacgtaaacagccgcagcctcctgatcgcccaaatcaaaaagaccggtctgcctttgaaattggcaggagacccgattgtctatgaaaaagtcgctttcccgtttgcgaaggatgcggcacacgataaaatccgcaaaaaagtaaacaaagccattgaagaactgcagaaagacggcacgctgaaaaagctgtcagaaaaatactttaaagaagacattacaacggaagaaaagcattaagaaacggcggtgaaaatcgagaatgaacagcattgattggggatttatgttttcagcttttcccgcgttaatcgaagccttgccgatcacattagtaatggctgtcgcggccatggtatttgccgtgatcggaggccttatattagcgcttatcacgaaaaatcgtattcctgtgcttcaccagctgtcaaaggtgtatatttcatttttccggggcgtgccgacgctcgttcagcttttcctaatttattacggcctgcctcagctgttccccggaatgagcaagatgacggcgttaactgcggcgattatcgggttaagcctgaaaaatgccgcctacctggctgaaatttttcgcgccgcgctcaactcagtcgatgaggggcagcttgaagcatgtctttctgtcggaatgacaaaatcccaggcgtacaggcggatcatttttccgcaggccatcagaaacgcgcttcccgcaacgggaaatacgtttatcggcctgttaaaagaaacatcgctcgcctttacattaggagtgatggagatgttcgcccaagggaaaatgtacgcatcaggcaacctcaaatattttgagacgtatttagccgtcgcaatcatgtattggattcttacgattatttacagcgtgctgcaggatctgctcgaacgggcgatcagcaagccttatcgcacataggaggaggctcgggatgatacaagtcagacacattcgaaaagcatttaaagaccttactgttcttgacgggatcgatcttgagatcaagagcggtgaagtcacggccatcatcggcccgtcaggctcgggaaaatcaacgctcctccgctgtctgaatctgctggagcgcccggatgacggcatcattgaaatcggtgatgccaagctgaatgcagcgtcctattcgcgcaaagacgtacacaagcttcgccagcagacggcgatggtgtttcagaattacaacctgtttaaaaacaaaaccgccctgcaaaacgtgacagaagcgctgatcactgcgcaaaagaaaccgaaaaaagaagcggaacagatcggtatggatctgctgcggcaagtcggtttagagcacaaagcggacagctacccgattacgatgtcaggcggacagcagcagcggatcgggattgcgcgcgccctggccgttgatccccatgcgattttactggatgaaccgacttcggcccttgatccggagcttgtagccggggtgctccaagtcatcaaatcaattgccgaaaaacagacaaccatggtcatcgtcactcatgagatggcttttgcgcgtgaagttgccgaccaggtcatatttatggcggacggacgcatcatcgagcagggaacgccggaagagctgtttgacaatccgcagaacgaacggacgaaaaaattcattaagcaagtgggagagcctgccgaacttgtctaagaagggatgaagaaaaaatggcaaatgaaacgtatgaatcattaaacaaacgtttaatcaatatccgccgcgaccttcatgaataccctgagctgtcaggcgaggaatacgaaacgacgggtaaaatccgccgctggctggaggaagaaggtatctcggttcttgatgttccgaaacttcaaaccggagtgatcgctgaaatcaaaggcgacaaaagcggccccgtcatcgctgtcagagcggacatcgacgcattgccgatcgaagagaaaacaaacctcccgtttgcttcgcgaaacagcggcgtgatgcatgcctgcggtcatgattttcatacggcatctattctcggcacggctttcttattaaatgatagaaagcatgagctgaaaggaacggtccggtttattttccagcctgccgaagaaatcgccgccggagcgagacaggtcattgaagccggcgcccttgagggtgtatcggcgatattcggcatgcataacaaacccgatctcccagtcggcacggtcggcctgaaagaaggcccgctgatggcgagtgtcgaccgctttgaaatgaccgttaaaggaaaaggcgggcacgccggaattcccgacaacagcatcgatccgattcaggcggcagggcagatcatcggcggcctgcaatcggttgtcagcagaaatatcagctcgctccataatgccgtcgtcagcatcaccagagttcaaggcggcagttcttggaatgtcatcccggatcgtgttgaaatggaagggaccgtccgtacgtttcaaaaagaagcgcgggaagctgttccgaaacatatgaagcgggttgctgaaggaatcgccgccggattcggggcagaagctgaattccgctggtttccttacctcccgtcagtcatgaacgacgcccgtttcatacagacggcggaacaaacggctgaaagcctcgggcttcaaaccgttcgggcagaacagtctcccggcggtgaggacttcgccttatatcaagaaaaaatccccggcttcttcgtttggatgggaacaaacggaacagaagaatggcatcatccagccttcacactcgacgaaaaagcgcttccggccgcggctgagtttttcgcccggcttgccgtcaatgtattggagcagacggaatgaatacggaaaatctgacggccgggcttgctcaggccgtcatgtcgtctgtgccggaaacatccgccgaagcgatgaaagaagcgcgcaaagggctgcttgattttacagcggcagcctttgcgggaagacgggataaaggcattgagaaactgataaagctggccgaagaagaaggcggagcgccgatagctccgcttatcggcagaaaacaaaaaacaacgccgtcccaatccgcgctgattaacggattcatcgcccatgcgcttgattttgacgatgtccattctgatgtaagagggcacccgagcgccgtcatccttccggctctgattgcagccgcatcatcaggccgtatagacaagagccgttttctcggtgcttacgtgacaggaatcgaagtgatggcgcggctcggtgagtcatcgggaagatctcattacgaaaaagggtggcacaatacggggacgttaggcgcgattgcggccgcgtgcgccgtcgggtttgcggagaacctgaatcatcatcagttgcagaaagcgatcgggtttgcggccgcccgttccggaggcatgcgtgtgcaattcggaacggaaatgaagccgctccatgccgggctggccgctcaagccggattgttcgccgtcaagcttgcgcaggccggttttggcgggtcagctcatgcgcttgacggggagaaaggctttttcgggctgtacggcgatcttgaacgggcagaaactttgcttttaaacggatggggaaaaccttggcggatcacgagcccgggactttggtttaaggtgtatccgttttgctcggctgcccatcatgcggcggacgccattctcaagctgaaggccgagcacggtctcaccttcagccaaacggaacgggtcgacgtaatttatccgcctggcggggacgccgcattgacagaacggcgtccgaaaaccggcgaagcgggacggttcagtgtggaatatgtgatctcgttagctttgcacggtaaagatctttcagctgaacatttcacatccgagccgattccggaattccttcaaaaggggttcgcgcggattcaccgcggctatgatgatcaaattcagccggctgacaacgccgttccgaagggccgttttacaattgtacgggttacggctgccggcaatcatgtgtatgaagcgcgtatcgactgtccgaagggtgcgccgggaaacggtctttctgaaaaagacattgaagacaaactcaggctcgctttgccaggagaagagaaaagagcggcagagttgatcaaagcagccggacagccgaatattgaacgttatttacagctgatataaataaaaaaagcgaggggatgcagccctcgctttttttacgttcacttctattgaatagggggatatagggtgcgcccctgtctgcgctggcaggggcgcggtttcaggaaacggctgtgccgttttcttttacggtgaaacttcctcttgataagcggatgttgatatccgaaactttggaaatttgttcatcatgcgtgaccatgatgacgcatttgctgtctttatgcgccagatcctgaaagagccggacgatttcctttgacgtatcctcgtcgaggtttcccgtcggctcgtccgcacaaattaaatccgtgtcacagcagaaagcccgcgcaatcgaaacccgctgctgctgtccgccgcttaatgtcagcacccgctgccgggcctgctgttccgtaatacccactctttccagcatgctgagcgcgaacgcatctttgtttttctctttagatccggtaatctccatcgccgttgtgatattctggagcgctgtcatatacggaatcagattataagattgaaagacgatagagacatattgatttctgaatttggtcagtccgattttggagatatcttctccgttataaaggatgcttccctctttaggtgtgtcaagaccgcccgccagagacagaaacgttgttttccccgttccggaggcgccgacaattgtataaaacttccctttttcaaagctgatcgttatatcctgaaacagcggctgtgatttgtcttggtaccaatagccggtctgttgaaaggttaataggctcattacgctgcctcctcttattcctgcttggtcaggatggttttaggatgaagccgcatgactgatacagacggcagtaatgtggcgatgacggcaatcgcgatgccgataccgccaagaatcagaaggtcattcagcgagacgtttacctgcatcgtgctgatgacgtccgtgcttgatgaatgccggccgaacataccgcctccgcgcggcatttctccgccgccccagccgcttgcttgctgctgtgaatcatcggctgagctgacctgctgagaaagaagctggtttccgagctgattcgctacaaggctgcctgtgacagatgcgataccgatggcgatgacggcgaccgccagtatttccgttaggaattgtccgatgagcttccagcgtttttcgccgatcgccattaagacacccatttcatacttgcgttccctgatcgacatcatcacgattaatccgagaatgaccgcgcccgcgatggatacaagatacaccacgtttttagaaaacgacgcgacattttcaatcgggccgaccatttgctgatacacctgatcattcgtcgtcagcgtgtacgttttataatctatggatgtttttttcgcagccgcaacgaatgagtcaatatatttggcatcatccatgtaataaacggctgagctgattttgtttttgttgtcagatccttttaacgccgctgcggcggtgtaaggcgtatagattttgttatcaggatttaagaatgaaaaatgctgtgcctgatcatctccggaagatgttgttttatagattcccacaattttaagcttcgttttcaccgaatcatctgatgctgaggaaacggtaatggagccgccgaccttcagcttgttttgatctgccagtgttttattgatcactgcgacttttgcgtccgcatctgtttttgtgatggcgcggccgtccgtgatttttgagctgccgtccgtgaaatcgtcaagcagtgccgtagagagcacgccttcgatcgaaatgtccgctgacatcatctgtcttccgccgccttgaaaacggcttccgccggaattgttatcggctgatgcgtctgagctttctatcgcgtcaaagctttctgcgtttgctgacgctgtcgtgagaaagttgtaatttttcacgtgctgtaaagatgtaagcttcttggcatccgagacggaaatcggcgttgattcaaacgtccttttttcaccgtctttttgctgctgcgccatttgcttttggcggtcaacctggagtgtgacactcccgccgagctgctgcctggccagttcgcttgatttctttgccgctgactggatcgtaaggccggacaggacaaaaatacaaatcaccgaaaacacaatcagctgcaataatgtttttcccttttttgccttcatgctccaaaaggctctttttataaaattcatgtctgttcctccgtgtgggtgtcagatcttgtaaaaccggccttctttagcaccggtcatccgatatgtatatagtaggagaaatgtatgaaaaaaatatgaacaaactatttccgggtgatgaaataaaaactaacaattgtgaaacgggaaaacatccgggtaaaatggtgctattataagaaaaagcttcaagataagcggaggatacaatgaagatattaatgatagaagacaatataagcgtatgcaccatgacggaaatgttcttttttaaagaaggatttgaagccgaatttgtccatgacggagtggaaggctatcagcggtttacggaggaggactgggatttggtcattctggacattatgcttccatccatggacggagtgacgatctgccggaaaataagagagacgagcagtgtgccgattattatgctgaccgcaaaggacactgagtccgatcaggtaatcgggtttgaaatgggggccgacgattatgtcactaagccgttcagcccgctgacgcttgtggcgcggattaaagcggtgatcagaagataccgggcgacggggcaggccgtaaaaagcgacgacttgatcgaaacggcatgcttttcaattaataagaagacgcgggaagtgtttcttcacggaaaatccgtcgagaatctgacgccgaaggaatttgatctgctcttttatctcgtacagaacccacgccaggtcttctcaagagaacagctgcttgagcaggtgtggggctatcaattttacggtgatgaacgtactgttgatgttcatattaaacggctgcgtaaaaaactgtccagtgacgaaaaaccgtttttgtacactgtgtggggggtaggatacaaatttgatgaggattaaatacttatatcagctgctgctgagccatgtcagcatcttgattttggcctttttcatcatcatttccctgttttcgcattttgtgaaagattttgcgtatcaaaacaaagtggatgagctgtcatcctatgcccaacagatcacaagtgagctgaacggccgcgatcttgatctgcgccgtttgtatccctatcaggacatgttaaaaacgcgcgagacccggtttattatttttgatgaacatcagcggccttacttttttcctgatgatatgccgccgcgtgagaagctcaaaaataaagagtggcacatgctgaagcaaggcaaaaccgttcagatcagagcggagatgaaccgttttaatacggaaggcttagaagtctcgcttgtcgcaaagccgctttttatcaacgatcaatttaaaggcgcggtgctgctcgtgtctcccgtcagaggggtcgagcagatgatcagccaggtcaaccgttatatgttttacgcgatcatcagcacccttatcatcacgatactgttaagctggcttctatctaaattacacgtcaaacggattcagacattgcgggatgcgaccggaaaagtggcgtccggtgattacgatatatcgcttaagaacagcggcggtgatgaaatcggcatgctggcgtccgatttcaatacgatggcccataatctgaagcaatcgcgagaacagattgaccgccttgaaaagcggaggcgccaatttatcgccgatgtttctcatgaactgagaacgccattgacgaccattaacggacttgtggagggactcaacagcaacaccattcccgaaaaagataaagagaaatgcttctctctgatcagtgaagagacgaagcggatgctcaggctcgtgaaggaaaacttggattatgaaaaaatcagatctcagcaaatcaagctggacaagctgagtctgccgctcatcgaagtgtttgaaattattaaagagcatctcaatcagcaagcggaggaaaaacaaaatcggctccggattcaagtggaggccggcgtcaaagtgttcgccgattatgacaggctgatccagattctcgtcaacattacgaaaaacagcattcaatttacgcaaaacggagacattacgctgcgcgggtatgaaggctataaggaaacaattattgaaattgaagacaccggaatcggtatttccaaagaagaaattgagcatatatgggagcggttttataaggcggacgtgtcacgaacgaatacggcatacggtgaatacggtctcggcctgtccatcgtgaagcagctcgtcgaactgcacaaaggcacgatagacattaacagcgaaaagggacaaggcacaacctttacaatccgccttccgctgaatacgaaaaatgaataatcttgaaaccggcagtctgtttggctgccggctgttttatcttcccttcgaaaaattgcgctctgccgaaacaaagtttgcgtgtttttcgggatggaaagacacggaaacgtgataaaataactggtaaacaggtcttggatggggagggtgaaggaatgaagagcgggttaattccttcttcagcagtcgggcagaagattaacgagtggtaccgatacataagaacattcagcgtgccggatgcagagatcttgaaggccgagatcaaacaagagcttgaccatatggagcctgattcgaacttagtactttattattccctcatggaatttcgccatcagctgatgctggactatttggagccgctggagaaattgaaaatagaagaccagccgaccctgtcggaaattctcgataacatagataacagccaggccgggctcaaagggcttctcgattattacgtcaactttttcaaaggcatgtttgaatttgataaaagagaatttatatcagcgatcacgtattataaacaggctgagaaaaaattggccttcgtatcggaccacgtggagcgcgcggagttttattttaaagtggccgaagcttattatcatatgaaacaaacgtatttttctttgatacatataaaaaatgcttatgaaatttacgtagagcaggacacatacaacgtccggatcattcaatgccattttgtgttcggcgtcaatttaatggatgaaagacgttttgaacaggcggccaaacattttcagcacgctctgcaaatggccgaaaaagaacaaaaagcgcagcttgtcgggagggcgctgtataacctcggactgtgctactacaatcagaaccgcatcgatgaagccataccgtactttgaacgggcagttgatacatttgaatcacaaagaatcgtcaattctctccctcaggcatattttctaatcacactcatttactttaaactcggaaaaaaagataaagcatcggaatatcacaagcggggatatgaatatgctaaagaaacagacgatcccgtttacacggtaaaattcgaatggctgcaggctctgtatcaggcgaaaccggatgaggaaaaaatcagcgcatgtttccgttacctcgaagataaaaatttatacgccgatatagaggatttagcactagaagcagctaaatattactatgaacaaaattgctttaaaatttcttctgactattttctgaaagtcgaagaggcaaggaaacaaatacaaaggagtgagggtttgtatgaaattgaaatctaaatggtttgttatttgtttagcagccgccgcgatttttacagctgcaggtgtaagccagacagatcaggctgaattccatgtggctgaaagaggaatgacgtgagaagaaaataactgaacaaaggaaaagactgcctgagaatgatcgcggcagtcttttttgtgtgtccggatttgggcagcggcggaaaacaaaaagaaaacgccgcaggtcaaaacccgcagcgtcttcatatagacggagtgatgtttagtaaccgccgacgaaggcagtacctacaattactaacaggataaataaaacaacgatcaaagcgaaagagctgattccgccacctgagtatcccatcatttgcttcacctccatattgtctataccatacaatatgtttcagaagctgttctgtaagggatattagtggacaagagaaaaaagaggctgtttcctatgagagtaagaccccggcgaaaaattcgtcatacagtgcccgcaccgcgtgtttttcctgttcttctttcactccgaacatcatactgacttccgatgacccctgattgatcatctcgatgttgacgccggctcccgacagcgctttggatgccctggcggttgtgccgacattatggcgcatcgcttccccgacgaccataatcagcgccagattgtgcctgacagtgacttcatcagcttgaagttcctgcttcagacgggtgacgagcttctgttccagttccgaatccatctgattgtgccgaagaatgatcgtgatatcgtcaatgccggatggaacgtgttcatacgtcaatccttcttcctccaaaatatgaagggctttgcggccgaaaccgatttcccggttcattaaatatttgcttatgtaaatgctgcaaaagcccgtgtcgcttgcgatgccgatgaccggcccgttcgtgttgtcacggctgctgacgacgcgcgttcctttcgcatcgggattgttcgtgtttttaatctgaacagggatgccggcacgaaatgcgggaataagcgcttcatcatgaaaaacggaaaacccggcataggagagctcacgcatttcccgatacgtcagttcgttaatttctttcgggtgcggcacgattgacggattgacggaatagacggcgtccacatcggtaaagttctcatacaggtcggcttttaggccgttggcgagaatggagcctgtaatatctgaaccgctccgggaaaacgtcacaatctcatgctccttcgtatatccgaaaaatcccggaaaaatgatcaatccttcgcggtttctcagacggtataaatgatcataagactcaggaagcacctgcgcgctgccgggctcattcgtcacaaacagccccgcttctttcgggtttacgtattccgctttcacgccctgcctgcggaagtaggctgcgatcagcttcgcgttattgtcttcgccgctcgctttcaccgcatccatataccggtcgggattggttttgcagctgtttaagagagcgaataagtcacgacggattctttctataatagagaaatccagatccagctcgcgcgcgatggcggcgtaccgctcaatgaccgtttcggcaagctcgggcgctgctcctttttgcaaataatgctccgcacagcggattaacagatccgtcacctttgtatcgttcgagaagcgttttcctggcgccgatacgacgacggctttccgcgcgggatcggccgtcacgatttgaaacactttctcaagctgggctcctgacgctagggagctgcctccgaattttacaactttcatgatttacatcccctaatgtttaaattttctcacaaatttaatttttattatctctctttcgaacatgtaaatcaaggattttttcttctcgaggagtacatttgtatttatggagaggaattcagctgctttctgtcagatttgcttcctcaaagcgtgtaatcacgtgtgaaaaatgataagcctccaaatgtaggttatagaaaatcctgcaaattattgatagactgattgtaagacaatttagtgtacggcccgcggatgaccgcttttgaagcaaaaccgtattgactgcgcttggaaagatgataagattatagttgtcgttgataatgataatcattacgagtggggatatatgggagttgtttggcaatgagtcataccgtttgtgatgggttcagggaggcagcatgaagctacgttacttacttttgttactggcggtattggcgtgtacttctatttttatcggggtagaagatttgtcgccgctggatatttttcatttaaataaagaacaggcaagtacattatttgaaagccggctgccgcgtctggcgagcattattattgccggcatgagcctgagcatctgcggattaattatgcagcagatcagccggaataaatttgtatcgccgacgactgcgggaacgatggactgggcgaggctcggaattttgatttcattaatgctttttacgtcagcgagtccgcttgtgaaaatgtcaatcgcttttattttcgcgttggcgggaaatttccttttcatgaaaatcctcgagagaatcaagtttaatgatgcgatttttattcctctcgtcggtttaatgcttgggaatatcgtcagctcaatcgccacgtttatcgcatataaatacgatctgatccaaaacctgtcgtcttggcttcagggggatttctcattggtcgttaaaggccgctacgagcttttatacctgagtatcccgctggtgatcatcgcttatgtgtatgcggataagtttacggtggctggaatgggagagagcttttccgtcaatctcggcctgaaatacaaacgcgtcgtcaatatcggtctgatcattgtgtcgcttatcgcttcacttgtgattttgaccgtcgggatgctgccgtttctcggtttgatcattccgaatatggtgtcgatctacaaaggggacaacctgaggagcagcctgcctcacacagctctgttaggtgctgtttttgtgctgttttgcgacattttgggaagggtgatcatattcccgtacgaaatttccatcggcctgatggtcggtgtgatcggcagcggcatcttcctgtatatgctgttaaggagaaaagcatatgagtcataataaaaaaattacgctgctggcggcgctcgccattatatgtatcggattctttctgttctacggattgggcaattgggaatactccctgccgagacgatgcttcaaagtgcttgccatgatgctcaccggaggagcgatcgcattttcaacggtcatcttccagacgattacaaataaccgcatactgacaccgggcattttaggcctcgattccctgtatatgctcattcagaccgtcatcgtgttcctgttcggttcaatgaatatcgtcatgatgaacaaaaaccttaatttcgtcatctccgtcgggctgatggtgctcttgtcactcgttttgtatcagctcatgtttaaaggcgaggggcggaacgtgtttttccttctgcttgtcggcgtcgtgttcggcacgctgttcaacagtctgtcatcgtttatgcagatgctgattgatccgaatgagttccaggttgttcaggacaaaatgtttgccagctttaacaatatcaacaccgatcttttaggattcgccggtgctgtctttcttctgacaggcatttatgtctggcggttcacgcggttctttgacgtgctgtcgctcggccgggaacacgccgtcaaccttgggattgattacgataagcttgtgaaacagatgctcattgtcgtcgctatacttgtgtccgtctctacggctcttgtcgggccgatcatgtttttagggctgcttgtcgtcaatctggcgagagagtttttaaaaacctacaggcacacgtatttaattgcgggttctgttctgatcagcattgttgcgcttgtcggaggccagttcgtcgtggagaaagtgttcacgttttccacaacgctgagcgtcatcattaattttgccggcgggatttatttcatctatttgctgttaaaggagaataaatcatggtagaggtcaaaaatgtaagcaaacaatacggcgggaaagtcgtccttgagaaaacgtctctttccattcaaaagggcaggctcacctcgtttatcggtccgaacggcgcgggaaaaagcacgctgctgtctatcatgagccggctgattaagacggattccggagaaatcacggttgacggacaagagatcgggtcttgcaaaagcaatgatctggcgaaaaaaatcagcatcctgaaacagacaaatcaaatcaatatcaggctgacgattaaagacctggtcagcttcggacgatttccttattctcaaggaaaactgacggatgaggattgggtgcatatcaaccaggcactcagttatatgaagcttgatgacttaaaggataaatatctcgatcagctcagcggaggacagtgccagagggcgtttatcgcgatgatcatcgctcaggataccgactatatttttctcgatgagccgctgaacaatttagatatgaagcattccgttgaaatgatgaagctgttgaagcggcttgtggaagacttcggaaaaacggtcgtcgtagtgattcacgatatcaacttcgcatcagtatattcagaccatatcgttgctttgaaaaacggccggatcgtcaaagaagggccggcggaggagattattgaaacctctgtgcttgaagagatttatgatatgaccatcccgattcaagagattgacagtcagcggatcggtgtgtatttttcttaaaaaccagatgaggtgaaagtcatgaaaaaattcgcattgcttttcattgcgctcgttacgatttttgttgtttctgcatgcggaaacggaaacggggacaaaacatcaggcaaatcaaaagaaacaatcacgattaaggatgacctgaacaaagaaggagtcaaagtgccgaagaatccgaagaaagtcgtcgtattcaacttcggaatgctggatacgatggatgaactcggtttacaggatcatgtcgcgggacttccgaaacaaagcattccaaaatacttatcttcatacaaaagtgataaatacgccaatacaggcggtttaaaagaaccggatttcgaaaaagtcgcggatattgatccggatttaatcattatcgctcacagacaatctgattcttacaaagagttctcaaaaatcgcgccgacgatttatcttgatgatgactatacaaactacgttgacagattcaagcataacaccgaagtgatcggcaaaattttcaacaaagaaaatgaagtgaaagataagcttgcgaaaattgacaaatccattgctgatctgaagaaaaagacaagcagcacggataaaaacggtttagtggtgatggcgaacgacgggaaaatcagcgcgttcggatctaaatcaagatacggcttcattcatgatgtgttcggcgtcaaaccggctgacaaaaacatcgaagcatcactgcacggacaaagcatttcctatgaatatatcgccaaaacaaaccctgattacttgtttgtcgttgaccgcggaacagcgatcggctcaaaatcttcaacaaaacaagtggttgaaaatgattatgtgaaatcggtgaaagccgtgaaaaacaaccatgttgtataccttgactcagctacatggtacttatcaggaggcggcctggaatccatggcgcaaatggtgaaagaagtaaaaaacggaattgagaagtaaaaaagaacccggtcacacaagtgatcgggttctttttcgtttagcgcgtgacggcctgctgctgctcgggctgacgcggttttttcttcaaagtaaaagatagcaggaatccggccagcgcgatgcaggcagctacgacaaatgccgcattcatgccgtgcagggcggcgtttgccggagacgacgcatttgcgtgcgcggcctggctgctcataacggaaacaagcagcgccgtaccgatagaaccgccgacttggcggacggtattgttcatggctgttccgtgcgggattaagtggcgcggcagggcgttgattcccgctgtcgtcaccggcatcataatcatggctgttcctaaaagccgcgcggtgtaaacgacgacaatccaaatgagagaagtcgagtctgtcagattcataaacggcagggacgtgagcaggataatgaagaatccggtcatcgcaaggccctttccgccgattttatcaaaaatccggccgataaacggagacatcattcccatcacaattgcgcccggcaaaagcattaatccggtatcaaacgcggatacgccgcggaccttttgcgtgtagagcggaagaatggtttccgtaccgatcagcagcgcgaaaacaagcgtgccgagcagggtggtcaggctgaaaatcccgaaggaaaacacgcggaattccagcatcggttttttgagcttgatctgtcttgcgataaagaaaatcagcgcgaccgctccgacaagcagcgaggtcagcacttcagtactggtccatcctgatgagccggcgcttgagaaaccgtaaagcagaccgccgaatccgagtgtcgataagatcacggataaaatatcaatctgtgtttttcgtaatgtcgtgacgtttttcatcagaataattgctaaaagcaaatcgatgactgcgatcggaaagataatataaaacaaagaccgccaagagaatgcttcgaccgcccatccggaaagcgtcgggccgatcgccggcgcgaacgaaataaccaagccgaccattcccatcgcgcggccgcgtttttccattgggaaaatcgtgagaaataccgtctgcatgagcggcagcataattccggcaccggccgcctggataatccgggccgttaataataccggaaagttcggggcgaatgcgccgacaatggtgcccgctgtgaaaatactcatggcggaaatcaagagggtgcggctggtgaatttctctattaaaaatgcggaaatcggaatcaaaatcccgtttgtcagcataaacgacgttgtcagccattgcgctttgttggcgtctatattgaagtcattcataatatgaggcagcgccgtgataagcagtgtctggttcaaaatggcgacgaacgctcccgccaaaagaatcccgacaatgacagagcggttgtatggtgcagtttcaatactcttattcaagctgattccttctttctttatagtttgagcaatgttttaacggctgcaagcggctggtgcagcggtccggcctgttccaaataaccgatgagcgcttttaagaggaaatcccgcggctgtttgtccgctgattctttctccagcatggatgccgcggaggcgagccctgcggcatcgtatttttcctccggaagagctgagacggcttctttcagctctttcaggctttcagccagcaatacggttttgcctttcggctcaaatgaggaagcggaggcgatataaaggtcaatcatctcctgaggcaaagcggtttcggttttcctgttttcaacgatgagattgaggtggcggatgataaactccgtgagcggctccagggcgagcggttctttttccagcttaatcagcgtgatgcattctctcaaaagcccctgaaggacaataaccagctcccatacataaggaatgatctcttcgccgtacgtctgaatcagtgaatctcgatgccagcagataaagatggagcgggccctgtgaatatgccgttttacccgttcattaatagaggaagggcttccgtacatcagcatgttaaagaactgctgattgcgcctgaaaccctcaagctcagccatcagttttttggcaaaccgttcttcaggggacaggcttgtttcttcatttaataatgaggcagccgctaccatctgtttctggttaaaatcaagcagctccaagagcagatcttcctttgattcaaacagcttatataaagatgctttggagactttgcactcctcggcaatcgcctgcatcgaaaccgacgaaaaacttttctcagaaaaaagctttcttgccgccagcagaatatccgttttcttatcattcataagcccagattccttctttcgtcacaatagaaaacccatcggttcacagaaaaccaatgagtatatgatgaaaatattaacaaaaatttttacacagtgtcaacgcttttgtttgcgaaaaagaaaaagcctgccggagtgtttccggcaggctgatgcgcttatttatccgtcttaaacccttgtttttcaagcatttcacgaatgtgaggataataaagctgtttatagtaggaggtgatgccttgtgaccagtttcttgtttcctgtccgccggtgcggttttgcatgtattcggacatctgcttgtcataggcctcaatatgtgttcttaaaccttcctcttgatacgtttcatgatgaagaacggctgcttgcggcagacgcggttttttcgcggagcggtctgccggatggccgatgacgagaccggaaaccgggaaaacgtatttcggaagtttcagcaattcaatcagttcatccggcttgccgcgcacggcgccgatcggcacagtgccgagtcccattgattcagccgcagctgttgccgtaccgagcgcaatcccgacatcaacggctccgacaagaacggactctaaaccgttcgttacctcaagcggtgtatcattatattcttcaagcgcaattttggcacggttaaaatcagcgcagaataataagaaaaccggcgcttggtcaatccacggctggccgccagccaattcggatatttttttctttcgttctttatccttcaccgcaataacggtaaattgctggccgttaatggaggtcggcgctgcttgagccgcttggatgataagatccagctgttcatctgatacgggctcatcggtgtagctccggatggaacggtggtctgttaatatttgaaggacttcgttcatgtcattcatcctttcgttactctgatagctctgtgcgtacgacatcaagcggcgcactcagcaggtctttggcttttgccacgaatccttggaaatggtcagtggcgttgtgggatttcatcgcttcttcatctttccattgctcaagcatgacgaaagtattttcctcaccgatcttttcgaaaaggtcgtattgcacatttccttcttccgcgcgtgaatgctgaacaagtgattgcgcttctcctaaaaattcctcgcgtttatccgcttttactttcatgtaggcctgtaaaacgatcattgttattcctcctgattgggtttatttgttatagttcgaatattatcgaactaactgtaacatgtatcgccgcgcaaggtaaagaaaaaacccttacggcctaaattgtcacccgccgcttatatgtgttacatttgactcatgaacattccaaaccatcctgaaaccgcccgcttacagctgacaaaggttcttcatgctctgagtgatccgctccgtttagagctggtcaaacagttggcggaaacaacagaaaaaacgtgcagcacatgtgctgatgtccgggtcgccaaatcaacgctgtcccatcacttcaaagtgctgcgggaggcgggggtcgcccaagtgcgcatagacggaaagcaccgttattattccctgcgcaaagatgatttacaagaggcgtttcccggcctgctggaggcgattttacagacagagccggaccgctggtaactaaatccccgaattccgggggtttttttatgcgccgaaaaccgcccggtacagccttgtaacgccttcttgaatctctttctccttcagacgggcgaatcccaggatgagctgaggtttgtttgattcgccgcccgctttcaggcggaaccggctcatcgcaaacaggtcgagctgttccgcatccgcccgtgccaatatctctttttctgaacgggggcagtcaaactcaatgacaaaatgaaggcccgcattggcgccctttacattgattctttctccgaatgtttcttccagggccgaaatgagacgctcacgcatgttcttataatgctgcttcatcttcttaatatgtttctgatattcacctgaatcgataaattctttaagcgccagctggccaagcgtgctgcacgtatgcaggtcatacgttctttctttgaacgcccgcaaaagtccgggcggcagaaccatgtagctgatgcgcaggccggggaaaagggattttgaaaaggtccccatgtagatgacgttttgaaaccggtcaaggctttgaagcgccggtatcgtgtcggcgtcatatttaaattcactgtcatagtcatcttctataatgaagcggccgtcctgttcggcggcccagtttaaaagctgaatccgccgggaagcgggcatgatcacacctgagggaaattgatgggacggcgtggtgatcaatacacagggccgctgcttttcgatttcggccatagacatgcctttttcatcaaggctgaccgtcgccgtctttttcccgaggttttgcagcagccggtacatcctcatatatcccgggttctccatggcgtacagcgcgtcttttggcagcagttccgtcagcagctgcatcagcatttgcgtacccgccccgagcacgatttgctccggccggcatgtgacgccccttgtcagagaaataagccttgagattgtttcccggacttcatataagccttgcggatggacgagttcaccaagcgtatgaaatgaacgggcggctgctttctgctcacagcgaaaccagcttttcagggggaaatgagccgtatccacgctcatatgtgaaaacgaaatccagccgcttttgtccggttcccgttctctcaaatcgtcaggcaataagagcgacggcgcttcttcgtgataaaacgtatcaatttcctcaacgaaaaagccttttctttcgactgcatataaataaccttccgaaagcagctgctgataagccgaattcactgaattcacgctgaccttcagcgtctcggcaagctcccgtttagacggcacctttgtgtgaggcatcaggctgcgcttcaaaacggccgcttttacgtgctggtagatctgctgatagatataatccgccgtttccgaatgatcaatggaaattgtcagcatacagaccctgacccctttctgataccatggataaattgattttggtacttttcatcataccaaaaagaagtcagaatgataagaaaacaatgcagggggatgaaatctatgagtcaaacagtatcatctgaagtgacaactgcccagtggcagcaaaaacgggatcaatttgtttccaatggggtcggcaacggaaaccgcagtatggcggtaaaaggcgaaggggcgcttttatacgatttggacggcagacgattcattgattttgccggagcgatcggaacgctgaatgtcggccattcccatccgaaggtggtggaggccgtgaagaaacaggcggaggctctcattcacccgggatttaacgtcatgatgtatccgtcttatattgagctggccgaaaaactctgcgccattgcgccgggagatcatgcgaaaaaagcgatttttctcaactccggagcggaagcggtggaaaacgccgtgaaaatcgccagaaaatatacgaagcgccaggctgtcgtctcattcacaagagggtttcacggccgcacgaacatgacgatgagcatgacgagcaaggtaaagccttataaattcggattcggcccgtttgcctcagaggtgtatcaggcgccgtttccttactattatcaaaagccggccggcatgagcaatgagcagtatgacgactttatcatcagcgcttttgatgatttctttatcgccgcagttgcgccggaaaccgtggcctgtgtcgtcatggaaccggttcagggagaaggcggttttatcattccttcaaaacgtttcgtgcagcacgtcgccgctttttgtaaaaaacacggcatcgtttttgtggcggatgagattcagaccgggtttgccagaacgggaacgtattttgcgatcgagcatttcggagccgttcctgatttgattaccgtatctaaatcactcgcggccggattgccgctgagcggcgtcatcggccgggcggaaatgcttgatgccgccgcgccgggggaacttggcggcacatatgcgggaagccctctcggctgtgcggctgcgcttgccgtcttggacattattgaagaagaagggcttaatcagcgctccgaggagatcggccgcatcattgagcatcaggcgctcgaatggaaaaaagagcatgcctgtatcggagaagtgcgcagactcggcgcgatggcggccatcgaaattgtcaaagatccggacacgcgagaaccggacaaagcaaaagccgcggctgtcgcaaaagcggcgaatgagaatgggctgctgctattgacggcaggcattaacggcaacattatcagatttctgacgccgcttgtcgtgacggatgaacagctcaaagaaggcctttccattatcgaagccgctttgtgagttcaattattggaatgccggcggatgggtctgctatcatgagagtgtgagatacatcaataagcattcaatggttttactatagcagagaaaggaatgttcaatatgccagaacaattaacagtttacaacccggcaacgggagaggcgatcgaaagcatccctcagcagacggccgaagatgttgaaaaagcgattgaacgttcacacaaagcgtttcaatcatggtccaaaacatcagcgggagaacgtgcttcccttttgaaaaaatggtatgagctgattgttgaaaataaagaagaacttgcggaattaattacgaaggaaaacggtaaaccgtatgaagaagcggtcggagaagttttatacggcgccggctatattgaatggtttgccgaagaagcaaaacggatttacggcagaaccgtacctgcgccgactacgggcaaacggattgtcgtcacccgtcaggcggtcggcccggtagcggcgatcacgccgtggaatttcccgaatgcgatgatcacccgaaaagccgcgccggctttggcggcaggctgtacattcatcatcaagccggcggaagatacgccgctttccgcttacgcccttgcgcgtctcgcatttgaagcgggaattccggaggacgtgctgcaagtggtgatcggtgacggagccgaaatcggaaacgtctttaccagcagtccgaaaatccgcaaaattactttcaccggctcaacgcctgtcggcaaaatcctgatgaaaaacagtgccgacaccgtcaaacatatgtcgatggagcttggcggacatgcgccgctgatcgtggatgaagacgctgatcttgatctggcggtagcccaaacaatggcctctaaattcagaaatgccggccaaacctgcgtctgtgcgaaccgcctgatcgttcacgaatccgtgaaagacgagtttgcgaaaaaactgagtgaagaagctgcgaaactcaaagtcggaaacggtcttgaaaaaggcgtaaacgttggtcccgtcatcaacaaaaaaggcttcgataaaatcgtcggccaaattaatgacgccgtggaaaaaggcgcgaaagtgctgacgggcggaacgtatgaccaaaacgatgaaaaaggatgctatttcgttacgccgaccgtgctgtcaaatgtagacacatccatgaacatcatgcatgaagaaacattcggtccggttgcgccgatcgttacgttctcagatatcgatgaagcgatcaagcttgcgaacgatacgccgttcgggcttgcggcttatttcttcacagaaaactaccgccgcggcatctatatttctgaacagcttgaatacggcatcatcggctggaacgacggcggtccgtccgcggttcaagcgccgttcggcggaatgaaagaaagcggcatcggccgagaaggcggtacggaaggcattgagccgtatctcgaaaccaaatacatgtcaatcggactttaatagctgaaagagagcccctgcttctaagcgggggcttttttaattgagcagtctgccggtgaaatcgccggcaggcttttttgatctcatgggaataatcggttcgattccagacaaaataacagcaaatacgattgaaagaaggtcgccatcatggatatattactggctcttctcccggctttgttctgggggagcatcgtgttatttaacgtcaaattaggcggcgggccttacagtcagacactgggaacgacaatcggggcgctcatcgtttcgtttgtgttatatctgtttgtccacccggtgctgtctgtgcggatctttattgtcggcatcgtatcggggctgttttggtcgctcggccaaagcaatcagctgaaaagcatacagctgatgggcgtttcgaaaaccatgccgatttcgacgggaatgcagctcgtctcgacttctttattcggcgtgatcgtattcaaggaatggtcaactcctatcgcgattacactgggtattctcgcccttatttttatcatcgtcggtattgtgctcacatctttagaagataaaaaggggcgggcggacggagaaccgggaaacttaaaaaaaggcattgtcatcctgcttatttccacgctcggttatttggtatatgtcgtcgtggcccggctgttcggagtatccggctggtcagcgcttctgccgcaggcgatcgggatggtaattggcgggctgctgctgacgtacaagcacaaaccgtttaataagtacgccctcaggaacattctgccgggaatcatctgggcgctcgggaatatgtttctgttcatctcacagccgcgcgtcggtgtcgcgacaagcttttctctgtctcaaatgggaatcgtcatcagcacgctcggcggaatcttcattctccgtgagagcaaaacgaagcgtcagctggtcgccattgcgatcgggattatcctgatcatcgtggccgcggtattcttaggcgttgcgaaatcaaattcataacaaatgcaggaggtttgaacatgtacacggatctaaaaggaaaagtcgttgccattacaggagcatcatcaggattaggaagagcgatggcgatccgcttcgggcaggagcaggcgaaagtcgtgattaactactacagtaatgaaaaagaggctcaaaccgtaaaagaagaagttcaaaaagcgggcggcgaagcggtcattattcaaggtgacgttacaaaagaagaggatgtcaaaaacattgtgcagaccgcggtcaaggaattcggcacattagatatcatgatcaacaacgccggcatggaaaatccggtcgagtcgcataaaatgccgctaaaagactggaacaaagtcatcaacaccaacctgaccggcgcttttctgggatgccgcgaagccattaaatattacgtagagaatgatattcaaggaaacgtcattaacatgtcgagcgtacatgaaatgattccgtggccgctgtttgtccactatgcggcaagtaaaggcggcattaaattaatgacggaaacattggcgcttgagtacgcgccgaagcgcatccgtgttaacaatatcgggccgggcgccatcaatacgccgatcaatgcggaaaagtttgcggatcccgttcagaaaaaagatgtggaaagcatgattccgatggggtatatcggtgagccggaagaaatcgcggctgtcgccgtctggcttgcttcaaaggaatcaagctacgtgaccggcattacgctgtttgctgacggcggaatgacacaatatccgtcattccaggcaggccgcggataagaaaaaaagcgatcgcagctcttatgagccggatcgctttttgctttatgcgcgttttttcttaacaagcgccgcgatggaaaggataatcgccgcagctgacagaacgatggccgcgatatcaagcgctgatacgccggatttgctttcttcttttgactgttcagctccgtgcgcatccgtcacgttggccgcttttgtgattttcgtaatcgagtgaggcgtgtcagctttttcatcacccgtccattctacaatgctgccgtctttgtaatattggtaggcgtcccaagcggcatccccggtcttttcagggtttttcgcaacaaatgtgaactgctggaattggccgggctgaatgccgccgttcttcgcttcccaagtgacggagaccgctttgtcatcatgctttgatacggacgttttccagcccggaatcggctggtactgctgaaattcaacgcccgcaggcattttcagcacgactttcgttgtcggctcatttttttccacaggcactttcatcgtgtacgtttcccaggaacccgccgcggattccgcgggtttgactgagacgtgggcgcttgctgttgccgtaaaaccgatgagtgacagggttatggcagacatgaatactaaagccttttttttcaacatgagatacactccttagtttgtggttgagaatatttgattgatttcattaaagtcgtttgtcagtccgtggactttgatcttccagtttcccttttcggtgatggacatattggcggcttcgaatgtgccttccttcgtttttttcaaatcaaaggtgctttcatgctgtttgccgctgaagcccgtctgataaaccgtcaccgtaaattgctgaatgtctttcacaaggctgccgttgtgatcggtgacaatgacttgaaattcatttttacccggctggttcggcgttatgtgcaaggacagggtttccccgtttccgatcatgtctgagccgttaaaaggcaatggcgcaggcggcggcgggctgggcaggcttgtgaagacggcggttgtaaataacaccgcaatccctattacccattcggcctttattgtgccgctgatgcttttgtttctgcggagttttgtcatccatacgtgaatggcgccgagagcaagcatgatgacaaacagtccgattttcaaaagaagcgtcttgccgtaagcggtgtgaaagagtgaatcaaacgaacggataatgaaaaatccgttcagcacacctgaaaataaaagcacgccgacagaggcgaatgcccaaggggagaaccgtctgaccgtttcccaggcgatggttttatcggtgtttctccactctgatgaaagaagcagcacaagcgcggctataccgcccgtccatacagacgcggctgataaatggagaaagtccattgtgatgccgaccgctttttcgtcaatgaccgccgcatgtccggcaaatgcttttgccaaaagcgaagcgaaaaagaacaatagcggcgccgtccagtacgcaaatgaccgaaatgctttcttcttcaacagcgggatcatggacacagcaagcaggataaataagctgatctggatcatccagacatacccgccggccgttttcagaagcgtttcttttacatagtccggctgaaacgcggcgctccaagcgccgcccgcgttttctttcgtctggatcgggagctggcagacaagcgcgagtcccattaaacataaagagataacgagcagctttacggttcggctgttttttgatgaactttcattttttctgaaccaaaacagatggaaaaaggccgtgccgataaacagggagagagcggtgtacaaaataccgcggtcgatggccgcttcggggtggagggccgcttgcgatgatgttttctcctgaaggtctccgccggctttcccgatactgaaaggaatgacgccggataccgggtgtccgtcagctgacaccgcgttccattccgctctgtaaatatcatgcggcagattttttttcaaagccgcggtcatgatgcgggaatcatttttttgaatcaccgttttgcccgcatcgacccgttcgccggatgaattatagaccttaatggagtggaagccttcttcaatctgttcattaaactcaatttcaatctgctttggcgcttgttttaattcgctgttctcacccggatttgagtttgtgatgtaggcgtgggcgaagcttgttttcggaatcaaaacaaggaacagcaaaaagatgagccagcgtttgttctgtctcatggctggtgacaccgccttccggttggttgttgttatgtcttgctgcaggtgcatcctttctgcctgtcgtgtaagatgatgtccgctgccttgtcaaaagtgcaaatgaccccgccgaagcctttttgaaaccgttccgcgtaatcaagcgttgagaaaggaatcgcctgaggccggcagcaatgaaggtcaatgtcggcatcgactaaaaagtatgcagaagcggccgtcagcgtcgtttggagaaggaaatccttacaaatgacgtgggacacttcttcctttttatcctcataccgcaaaatcgcgcaatgaatgcagcacatctgctcaacgttctgtgaaacggtaataagctgaacggaatatgaatgctgaatcggccgcaggcaatagccgcattgattggcgctttgttctgaagcgggcgggagcgtaatgccgccgggtgtccggataatccggtttgcatccgccagctgattgacgtctctgtacacggtcatctcggagacgccgaatctctcgctgatgtcagagattttcagcgcgccctcttctttcagccattcaagcaatgtttgctgtctgttaatcggaagcaattctgcatcctcctttttatgcgaatgagtgatgaacctccttctaagagtagatgttttcacaaatgtgtacaagagcctgatgataaaatatgtgaaaatatgttgaacaatcacaaatgtaaaacgcggagacagactctgttataatagaagagttgaatggaggaataaacatgaaagaaacgacctgcccgaactgcggcaagccgattacaggcgacatggtcagatcatccataatcccgtgccagtttgattgcgggcactgccatgtgaaattgcgtgaatataaagtatcagctccgattatggctgttgccattgcgataacggtccttttgatttatcttgtgcagatggcccgaaccgctgtcatgccgatgtttccggcggcgcggtatgtgccggccgccattttcgcgctcgtatgcgcatatccggtgttcattgtcagtgagcggctcattgcgaaactcgtcgttacaaaaggacacattatatacagaaagcggtaagacaccttgttatgaggtgtctttttttagttaaggatttgtcacactctatgtgccaaactcctctttacttttcattgaatgaggattgtaagcgttttatgatgaagacacaggggagaaagaaaccccatgtcttatttatttcatcttaaggcgagcatacagggagggaattgacatgcagcaagaacagcaagctggcatgaaagtgaagatacagcggttcggcagttatttaagcggtatgatcatgccgaatatcggcgcatttatcgcgtggggaattatcaccgcgctgtttattcctaagggatggtttccgaatccgcagctgaatacattggtaagcccgatgattacgtatcttctgccgcttttaatcgcatatacgggcggaaaaatgatttacgatcatcgcgggggagtcgtcggggcgacggccgccatcggagtcattgtcggagcagacattccgatgttcttaggcgcaatgattatggggcctttgggcggttatctcattaaacaagtagatcgtttatttaaagataaagtcagacagggttttgaaatgctgatcaacaacttcacggcgggaattatcggcgctgtgctgacaattatcgcgttttatgcgatcggcccggtcgtcctgtctcttaacaaattgctggcggcgggtgtggaagtcattgtccatgcgaatttgctgccgattgcaagcgttttcgttgaaccggcgaaagtcctgttcctcaataacgcgatcaaccacggcattttaagtccgatcggaatcgagcaggccgcaaaagcgggtaaatccattctgttcttagtggaagcgaaccccgggcctggactcggtattttactggcatacatgttctttggaaaaggctcttcaaaatcgacggctccgggagcggcgatcattcatttcttcggggggattcatgaaatctatttcccttacattttgatgaaaccgatgttgatcctcgcggcgatcgcgggaggagcgagcggactgctcacattctcgatttttaacgcgggacttgtcgcggcatcatcgccgggcagcatcatcgccattttagcgctgacgccgaaaggaagctatctcggtgtgctggcgggcgtcatcgttgcagccgccgtatcgtttatcgtatcggcccttattctgaaatcatctaaagcgggtgaagaagatctgacagccgccgcggaaaaaatgcaggaaatgaaaggcagaaaaagcgaagcggccgctgcgttggcagatacagaggaagagcctgaaagcggcgcagccgatatttccgctgaccaagtcagccgcattatcttcgcgtgtgatgcgggtatgggatcgagcgcaatgggcgcgtccattttaagaaacaaagtgaaaaaagcagagctggatattgatgtgacaaatacgtcgatcaataatcttccggatgacgcggatatcgtcattacgcataaggacctgactgaccgcgcgaaagcgaagcggccgcaggcggtgcacatttcggttgataatttcttaaacagtccgaaatacgatgaactgattgaaaagcttaaaaactaatcaaacagaaagagggattttcatcatggaagtattggctaaagcgaacatcaaactgaaccaaacagtgaactcaaaagaggatgccatccgcctggcgggacagacattaattgataacggttacgtgaaaaacggctacgtggaaaaaatgttcgaacgtgaagaaacatcatccacttttatggggaatttcattgcaatcccgcacggcacggaagacgcgaaggaagaagtgcttcattcaggcatttccatcatccagattccgaatggtgttgaatacggtgaaggcaatacggcaaaggtcgttttcggcatcgccggaaaaaacaatgagcacttagacattttgtcaaacatcgccatcatctgctcagaggaagaaaacatcgaacggctgatcagtgcaaaaacggaagaagaactggccgctattttcagcgaggtgaactgacatgattgcccttcatttcggagcgggaaacatcgggcggggctttatcggcgccctgctccatcattccggctatgatgttgttttcgctgatgtgaatgaaacgatggtcggccttcttaatgaaaagaaggaatataccgtggagcttgccgacggcggccggcagacagaaaccatcggccccgtttcagccatcaacagcgcgaagcaagaacaagagctgtacaggctgatcaatgacgcggcgatcattacgacggcagtaggaccgaatgttctcaaattcatcgccccgtcaattgcggaagggctgaagcgcagaacgtcctctgagcctctgaatatcatcgcctgtgaaaatatgatcggcggcagcagttttttgaaaaaagaggttttcggacatttgacggaagcggagcgggaactggtgaatcagaaggtcggcttcccggattccgcggtggatcggatcgtgccgattcagcaccatgaggacccgctgaaagtatccgtagagccgttttttgaatgggtcatagacagaaccggctttgccggcggtcagccggcactgaaaggcgcattgtttacggatgatcttacgccgtttattgaacggaagctgtttaccgtcaataccggccatgccgttacggcttacgtcggctatcagcgcggattaaaaaccgtcaaagaagccatcgaccatcctgaaatccggcgtgtcgtgtacgatgccctttcagaaacgggcgagtacctggtaaaagcgtacggctttaagcaagccgaacacgagcagtacatgaagaaaatcatcagccgttttgaaaatgaatacatcacggatgatgtgacgagggtcgccagatcaccgctcagaaaactcggagcgaatgatagattagtagggccggccaaaaaaataaaagaaccgaacgcgctggcagaaggcatcgccgccgccctgcgctttgactataaggatgatccggaagcggttgagctgcaaaagcttatcgcggaaaaaggcacgagcgcggttcttcaagacatttgcggtattcagccgcatgaaccgctgcacggcatcgtacttaaaaagctgaatcaataagatgaatccgcgtcgggggacgcgggtttttttcttctgttataatgtgagggaagggaggctgcgtgatgaatgaggagcttttgccccatcgttatccgtttcttttattgacggcatgaagaacagcgaagccggaaaatgggcggctgcttataaatacatcagtgaaaatgactggtttatgtcagaatcacagagagagatgccgttttcgctcatcgttgaagcaatggcccaaacggccgcctgcgcggggattacaggtgaaaacagtctcggcctgctgtctgcggtgaagaaagcggaaagattaggtgccgctttgccgggagaccgtctggatcttttgtttgaagtcacgcgaatcaggcgcgggtttgtattcggccgggcgaaagcgtccgttgccgggaagcctgtcgcggaagctgagatcagcatatttatccagccatcgtaaaaaaagccgccttcagcggcggctttcggacaagcctgtcattttgtatcataatctctttcactttgtgaattgttcctttggtcgtgtttgtgtttttcgtcattggcgttttccttcagctcttccagcggaatcggatcggttaaatcatgatgttcaggattttcattcggtttgttcttctgttttctttctttcatccttcatcacctcaatagttcttttcctcaacgttctccccgccaaacgtcagggagcggttttttgttcctgtgggtcatatgtattaaaatagaaacgactacattataaaaagtgaggtacatatatgccgatacaaagagaagacgcagatattaaactgatcgcgattgatatggacggaaccctgctcaatgacgagcagctcatcccggaggaaaaccggcgggcgatcaaggaagcggaggcgaaaggaattcacgtcgtcatcagcaccggacgcacgctgatgacctgccgcgagctggctgagtctctcgagctgtcatcctttttaattacggcaaacggcagcgaaatctgggattccaactttgagctggttgagcgcaagcttctgcataccgatcatattcaaaaattatgggatctgagaaataagcacaacacgaatttctgggcctctaccgtcgatagagtatggagaggggaattcccggaaacgattacggatcaccagtggctcaagttcggatttgaaatcgaggatgacgatgtgcggaatgaggtgctgaaagagctgaaggaaaacaaggagctcgaaatcacaaactccagcccgatcaatatcgaagtcaatgcgctcggcattaataaagcggcagcgcttgcgaaggtttcggaaaaactcggcttcacgatggaaaatgtgatggcaatgggcgacagtctgaatgacattgccatgattgaaaaggcgggcgtcggcgtcgccatgggaaatgcgcaggacatcgtgaaagaaacggctgactgggtgactgatgtcaacacggaaaacggggtcgccaaagcgatccgccactgggtgctgtaatagaaaaaagagggtctctgtatgaggctctcttttttgttttgtcacatttctgactaggtccatggtaggttttctgacaaaaggatgttcaaatctgtcagaattgatataatgaaaaaagtccaataattcggaatagtcgttccgaatagcggaatgataataaaataaaacgtttacaatacaggagggatcttatgtttcagattgacatcaattgtgatttaggagaaagtttcggtgcttataagatcgggcttgatgaagagattttggattatgtgacatctgcaaacatcgcctgcggctttcatgcgggtgatcccaccgtgatgcgcaaaacagttgcgcttgcggcggagaaaggcgtgaaaatcggcgctcatcccgggctgttcgatcttcagggattcgggcggaggcagatcgcgattacgcccgaggaagcgtatgatctgacactgtaccaaatcggcgcgctgtcaggatttttaaaagcagaaggtgtcgcgatgcagcatgtgaagccgcacggcgctttatataatatggccgccgtcaaccgcggtctgtcagatgcgatcgctcaagcggtttttcattttgatcccggacttattttattcggactttccggaagcgagctgattaaagcgggggaccgaatcggactgcagacggcaagtgaagtgtttgcggaccgcacctatcagaaagacggcacgctgacgccgcgttcacagccggatgcgctgattcaggatgacaaaaaagcggtcgggcaagtgatccgaatggtgaaagacaatacggtgacatctgcggagggacaagctgtaaacctgaaagcggacaccgtctgtattcacggagacggcgcccatgcgctcacattcgcaaaaacgatcagaaaagaactaaaagcggctgacattcaaatcagcgcgcttgcaaaagactgagcagcagagggaggaagacagcatggaacaaaagaaaaaaacagccggaaaggctcccggcagatggtcgctgcttttaggcgcgacatttctgatggcgacatcttcaatcgggcccggctttctgacgcaaacggccacgttcaccaatacattggcggcaagcttcggctttatcattttaatctccattattttggacattttcgcacagaccaatgtgtggcggattatcgcagtttccggaaagcgcggccaagagattgcaaatatggtgctcccgggcgccggttatgccattgcttttctggtcgtgctcggcggacttgcgtttaatatcggaaacattggcggcgcgggtctcggccttcaagtattattcgggatcaaaccggaaatcggcgctttaatcagcgctgcggtcgcggttctgattttcgtcataaaggaagccggaaaagtcatggaccgttttatgcaaatcgccggaatcgtcatgatcatattaacggtgtatgttgccgtaacgacggccccgccggtcggacacgccgttgcgaaaacctttatgcctgatcatatcagtgtgctggcgatcgtgacccttgtcggcggcacggtcggcggatacattacatttgccggcggccaccgtttacttgattcaggcatccaagggaaggaagtcattcctcaggtcacgaaaagctccatcacaggtgtcttaattacatctattatgcggattgccctgtttctcgccgtgctcggcgtcgtctcaaagggcctgcgtattgatcccgataatcccgcggcttctgtattccggcttgcagcgggaaatgtcggctataaaattttcggcgtcatcatgtggtctgccgctattacgtccgtcatcggcgcggcatatacatcggtgtcattcttcaaatcgttctcggcaaaaatcgaaaagcattcacacggcgtcattatcggttttatcatcgtatccacgctcatttttgtcacgatcggccagcctgccaaaattctggtcgcggtcggttcgcttaacggtttaattctgccgcttgcgttagcgatgattctgttgggcgcttataagaaaaaaatcgtcggcgattacaagcatccagtctggctcactattgcgggggcgacagtagtcgttgtcatggcgattatgggcatctatacattattctcgcaattgccgcagctatggagctgatgacatgaaaaaacatatgagtgacatgactcccgaagaagtcagacagcttatcaggaaggggcagatgaccgggccgacggcaggatgggccgcttcttatgcacaagccaatctcgtcgttttgcaaaaggatcttgcctttgattttctcttattctgccagcgcaatcaaaagccgtgtccggtgcttgacgtgacggatacgggctcacccgtaccggctgttgcggcgccgggagctgatatccggacggactttccgaagtacaggatttatcggcatggcgtgcttactgaagaggtaacggatatcacccggtattggaaggatgattttgtcgggtttttgatcggctgcagcttttcattcgagcaagcccttatcaatcagcaaattcccatcaggcacatcgatgagggagtgaatgttcccatgtatataacaaacattgactgtgttccggccgggcggttttcaggaaagatggtcgtcagcatgaggccgattccggaaaggcttgcagtccgcgcggcgcaggtcacgtcacgttttcccgccgtacacggcgcccccgtcagcatcggaaatccgaaaagcatcggcatcagcgatttgaatcagccggacttcggcgatgccgtgacggtgcgggaaggcgaagttcccgtattctgggcgtgcggcgttacaccgcaggcggtgatcatggaagcaaagcctgagatcgtgatgacgcattcaccggggcacatgctgatcaccgatatccggaatgaatcgcttgctgttctgtaagtgagaaagaaaacaacgaggtgatgacaatgatgcagtatagcggcaatacagcgcttgatatacagccgcacggtgattccgccgttatcatccgctttggcgggcaaatcagcgaagaggttaacagccgggttcatgcggcggcggcctgtattgaagaacggccgtttccgggcttcgttgaatgtatcccggcatttacgagcttaacgatcttttatgatgtgtatgccgtctcaaatataaaaaaaggcgtctctccttttgcattggccaagaaagaagtgatagaacgcctcagccatttaaagaccgacaggcaaaaagagcgccgggtaatggaaatccccgtttgctacggcggtgatttcggtcctgatttagaagaggtcgctaagatgaacgatctgacgccggaagacgtcatccgcattcataccgaaggcgaatatctcgtctatatgctcggattcgcgccgggatttccgtttttaggaggaatgtctgagcggatcagagcgccgagaaagtcgtcgccaaggccgtcaatcccggccggttcagtaggaatcgccggaatgcagaccggtgtgtatccgatatccactcccggcggctggcagctgatcggcagcaccccgcttcggcttttcaggccggaagaacatccgccaagcctgttgagagcgggcgatacggtgaaattcgtccgaatcacagcagaagaatacagccgcatcaaggagggagccgaatgagcatgaaagtggtgaagcccggtcttctgacgacgattcaggatacggggcgaacggggtaccagaaatacggtgtactgggaagcggcgcaatggatacgatctctctgcgcattgccaatcttcttgccggaaataaagaaacagaagcaggactggaaattacgctaatggggcccggtccttcctttgagctttcagaaccggcagtcattgccgtcacgggggctgatttcgcctttcatattaatggagaaccggcccctctgtggaaaccggttcttgtaaaggaaaacagcgttgtttcatttggaccgtgcaagatggggagccgcgcttatctcgccgtcgcggggggatttgacgtgcccgccgtcatggaaagcaaaagcacgtatgtcagagcggggatcggcggcttttacggaagagccctgcaaaaggatgatgaacttccgctcggcagtatgacgcagtgctcggaaatcatcgcgcaccgtttgagcgattctctcgggcagcatggtttctcagcgcctgattggtctgtcagcagcagaggttttctgccgctgaaaaaaaatccggtcattcgtatgcttgaaggggcgcaatttcatgcttttacagaagaagcaaaatcacgtttttacaaagagccgtttacggtcacgccgcagtccgaccgaatgggctaccggctgaagggcgctccgcttgaattacaggagccgcttgaaatggtatctgaggccgtgacattcgggacggtgcaggtgccgccggacggcaatccgattattctgctggctgacaggcagacgacgggaggctacccgcgaatggcgcatattatatccgccgatcttcctcttgccgcccaaacgatgccgggcgaacatatcacgttctcggccgtttcgctggaggaagcggaaatgctgcttttggagagggaacagcagataaaggagctgaaagccaggctcaaaatggaatggctgatctgacaaaggggctaaagaccatggaaaacaaaaacaaaaccgtcatcaaatcaatggagctgcttcatttgtttctgactgaaccaagcctgagcctaaatgagcttgtttctcgatcggagatgccgaagacctcggttcaccggatggcaagttcactggaggaaatgggatttctcacccgggcagcggacggccgttatcagctgggtctgatctttttgcaattcggccagcttgtctctgagcgtctggacatcaggaaaatagccaagccgataatggaagagctgtgcggtgaagtggatgaagccgttcagctgattatgagggacggcgatgaagccatttacgttgaaaaaattgaaggcacccaaaccgtccggctgtttaccgcaatcggccgccgctcgccgctgtacgcgggggcgtgcgccagaagcattttatcgtttctgccgagagaggagattgacacataccttcagaagacagagtttgccgcaattgcctcaggcacgatgacgaatccggctgaactgcttcaatctattgaaacgtcattacaatcagggtatacgatcagctattcggaattagaggattacacggcggcgattggggcgcctattttcaaccacgaaggaaaggtggcggcgggaatcagcatcgccggctttgaagccaggttttcagaggatcggctgccgtatttaacggaaaaggtcaaagccgcggcacagcatatttctgagaaattggggtattgaccgagccaattttccttcgctcgcgtacattacaatatcgacagtaatgagtggaggaaagtaaatgggacttgtttatacggcgctaggggattctttgacgacgggaaggggatccgggccgttttcccccggctttgttcagcggttcgggtgtatgatggcagaagatttacagacaaggaccgaggtatccatctttgccaagtcaggccttgagacgggagaaattctcgggcttatgtccttgccgtacattcagaggcggattcaggctgctgatatgattacgattacgggctgcggcaacgatttgatcgattcggttcgggcgtatcagcaaacgaaagacgcttcggtgttcgccggcgtgtcccgtcactgccatgagaactttgaaaagatgattgccaagatcgctgccttaaaagaaacgcacccctctccttatgagatccgcgttttcaatttatacaatccttttccgggcatctccattgcggaaaaatggatatcttcttataatgcgcacctcagcacactcgcatcagcgccgcacgtcaaaattgccgatgtccacagcgctttcaaaggaaagctgaacgaatatctctctcatgaccgcgtacatcccaacagcagaggatatgaagtcatggcatgcgtcctgcgggggctcggatacggaagcctcgcccgctcataaccgcgcgctccttttcatcgggagcgcgcttttcgttctccttaaaacaaacttaaaattgtccgactttcgttctatccgtgcaaaaagtacgctagaataatgggggataaagacagaaatagaattgtgttcaaaaaatgataacagaaaggatggattgctttgctgcgcgccttaaaactgtcactcgcgatgctgattattatacttgcggccgccgcatttacgtatgcggaacatacctctgtcatacagccggttatgctcgtgtttctcggtgcggtcatgttcattcagggactggaagaaaagcggaaggaaaacgacggttcggggagattcaatatctataccgctgtttttgtatggtcgatctccttaatcggttttacgcttcacgcgatctgagtttgatagatcctcaaaatgttccacaacgggaaatggtgaataaaaacggtgaagtaaggctttccattcctgatattccggtgatccgcgaaagccttttgtatgatcctccaatgtctcccattccacaagcagcaaatatttatgcgtcttttccatacatttggacaaggaatgggacagataacctttcatgcccgatataatcggctccgcccggcggaatgcctcttcgaattccccttcaaagccttcttttacatgcagcatggctgcttctctgatcatctgaaattcccccttttttaatagatacattgtataagtatatggaccgtgatggctggaaaaacaaaaaaattttaaacgctataagaaaaaaatccttgccagcctgatttgatttaggagaaaataacaattggaaggcaggggaattaacagtgaaaaaaggattatacctattacttttactcgcaggaatcctaggtttgatcggctgttcgaaaacggagtcggccgaagacagaatgaaagatttcgtgaaagactggaacggcggtcattacgataagatgtaccaaagcctcacacaggatgaaaagaaaaaattgtccaaaaaggattttgtaaaacgatatgaaaccatctatgaacaagcaggggtcaaaaatctgaaagtcactgccgaaaaacaggacgaagacgataagaaaaaagatgaccttcagcacatcgattataaagtcagcatggatacaaaagcagggaaggtcgcctttgaaaacacggccgtcctgaaaaaagaaaaaacagacgatggagaagcatggaacatcgactggaatccttcttttattttcaaacagctttccgacgacaaaaccgtgcagatcgcaaatgaagaaccgaagcgcgggcaaatctacgacaaagacggcaaaggcctcgctgtgaatacggaggtgccggaaatcggcattattccgggaaaactcggcaaggataaagacagcgtaatcaaaaaactgtctgaaaaactggacctttctgaagacgatataaaaagcaagctgaatcagggctgggtaaaagacgactcctatgtcccggttcaaaaaatcagaccggatgacgaaagcaaggtcaagagcctgctttcattagacggcgtgacgaaaacgacagtcagctcccgctactatccgtacggcgaaaaagcggcccacctgaccgggtatattaaaacgatcacagcggaggatctgaaaaaagcaaaagacggccaatacagcgacacctccaaaatcggcatcgccggccttgagaatgtatatgaagacaagctgcgcggcacgaccggctggaaaatttacgttccgcaaacgggtgaggtcatcgctgaaaagaaagccaaaaacgggcaggatattcatgtaacgattgacatgaaaacgcagacgaagctgtatgattccatgaaagatgacagcggagcggcagtcgccctcgaaccgcaaacgggagagaccctcgcgcttgtcagcgctccgtcttatgacccgaacggctttatcttcggctggaacagcaaagaatggaaaaagctgaatgaagataaaaacaatccgttttcagcgaaattcaacaaactctatgcgccgggatcaacgattaaaccgattgccgcggcagtcggcctgacaaacggaacgttgaaagcatcagaaaagaaaaaaatcaccggaaaagagtggcagaaagattcaagctggggcggctaccatgtcacacgcgtatcagagcgtctgaatgaagtggatctcgaaaacgcgctgattacctcggacaacatctactttgcgcaaaatgccatagatgccggagctgacgcgtttacaaaaggattaaaatcatttggttttgatgaagacattccataccaatttccgattgaaaaatcgtcaatcgctaacggcaagcttgattccgagattcttctcggagatacgggctacggccaggggcagatgctgatgtctccgctgcatttagcggctgactataccgcatttgtaacagacggaaatctcgtcaaaccgacattaatcaaagacggagaaaaaacaccgcaaatctggcataagcaagtggtatccaaagccaatgccgaagaaatcacaaaagggctgagaggcgtcgttgaagatccgcgcggctctgcatatcagccggtcgtaagcggcattaacgtagccggaaaaaccggtacagccgagctgaaaacgtctaaagaagataaagacggcaaagaaaacggctggtttgtcggctacgactataaaaagaaagacctcttgatcgccatgatgattcaagacgtcaaaaaacgcggcggaagccattacgtcgttgaaaaagcgaaacagcagtttcagaaccggtaaatgacgatttttccgggctgaaaggaaaatcggccgccgaagcagaatgaaacagcatgggcaattcctgaaacagagatacaagaggctcactaagaaaaagggggatttcacatgcagcgtattcaattggctgaagatctggaattttcaagagtgatacacgggctttggcgtctgaacgaatggaattattcggacggggagctgctgaatctgattgaatggtgtatcagccaaggcatcaccaccttcgaccatgccgatatatacggcagttatacgtgtgaaaagctgttcggcggcgctttatccctttcgccctcaataagggagcgaatcgaaatcgtcacaaaatgcgggattgtcattgagtcgccggaacggcccggaaacaagtcgcatcattataatacgtcgaagtctcatatcttagcgtcggcggagcagtcgctcttgaatctgaatacggattatctggatgtgctgctcattcacaggcaggacccgcttatggacccggaggctgtagctgaagcgtttcatgcgctgaaaagctcaggcaaggtcagatacttcggggtatcgaactttaaagcgcatcagtacagaatgctcgaatcctatttggatgaaccgctcatcacgaaccaaattgaaatctcggcttatgagctggaacattttcatgacggcacgctggatttctgtcaggaaaaacgcattccgccgatggcgtggtcaccgcttgcgggcgggagcgtctttaccggacaatcggataaggacgtccgaatccgtaccgcgcttatttcggtgcaggaagaaatcggcgccgcctccattgatgaagtcatgtacgcatggctgttcacccacccggcagacatcatgccgattgtcggcagcggaaaacagaaccgcatttccgcggcggtgcgtgcttcagcgtacaagctcagccatgatcagtggtttcggatctatacagctgtccaaggttatgatattccataaccaaaacaaacgcccggaaggctatcttcccgggcgtttgtttatgtggtgtgcaatgtcaaaaaacaagtaaggtcactttgaagtatagccgtgcggatcaagagaaacaaacgtcacggcatattatctgacacatttttcttattcaatactgtcacacggaccagtgccaaattgccatttgaaaatggttgtatattctttgaaagcgttttatattagaagttacactactttccccggcagcaccccccatgtgccatacctctcacaactagaaaatctggaggcgcgtttcatgtatatgacagcgagagaacaaaaattaatgaaacatcttttactgcagaaccgatacgagacagtgcatgaactggcagaagctttacaagtcagcacaagaaccgttcaccgcgagttaaaaacaatcaaaccgatgatgaaatcattcggcttggcacttgataaacagcccggcaaaggactgaaagcggtgggaaaaccggaagataaacagaagctcctgtcagagctgtcctatgaacagcaggaatacagcgcggaggagcggaaacttttaatcctatgttcgctattagagtcccaagagccgatcaagctctacagtctggcgaacgagctccaagtgacaaacgcgacgatcagttatgatctcgatgagctggagacttggattgctcccttcggcttgacgctgatccgaaaaaggggcttcggcattcagctgacgggaccggaaaatgcgaaacggaaaatcgtcggcaatctcatggtcaaccgccttgatattcaaacctttttggaagcggttgaattcaatattaaagggaaacccgacgctgctgaaaagatgttcggcgttgtaaataaagcggaacttttgaaaatggaccggctcttgattcagctcaaggaaaaaatcgcgatcgctttatctgacagctcttacatggcgctggcggttcatttaacctttgcgatggaccggatcagactcggagaaaccatcacgatggaagcttcggaactaaaagcgctgcagcagacgaaggaatacggctccgcgctcgaaatggcaaaagagcttgaaaaagcgttcggtgtttcgattcctgaggcggagatcggctatatcaccattcatttgcggagcgccaaccgcaaatacaaaaccgaattcaaaccggaaaacattgaagttgaaacggccttgcaaacgaagcagctgatcggcttcatttctgaaaaaataaaaattgatctgacggaaaacggctctttatatgacggtttaatcgcccatctggagcctgcgatcaatcgggtgaaagaaagtatcgacatgtacaacccgatgactgagcaaattaaacgcgactacttcctgctgtatatggccgtagaagaaggaatggaaaaattctttccggggcttcgttttcctgatgatgagatcgctttcatcgttcttcacttcggctccgctctggaaatcaaacgggaagaggcgaagatcaaagcgctgatcgtctgttcaagcggcatcgggtcgtccaaaatgctcgcgtccagactgaaaaaagagctcccggaaatccgttcctttgatatgtcttccctcatcgaactgaagaaccgtgacacctcggcgtacgatatgatcgtatccaccgtgccgatcccgtatgaaaacattgattacgtcatggtcagtccgcttttaaatgaagaagacgccgatcaggtcaagcagtacatcaaaagaaagattccgctgattcttgacaaaaaaagaaacagcaaaagagaagagaagcagcctgagacgcctgatatgctggaagcagccggacgtatggcgcattacgcggcggttatccaaagcgtgctgcggaacttttcgatcaaatccattgattcacacatggcgtatgagttgtttttgaaccatctctttggcgtgcttgagcaagaaggatttgtccgtcatgcaaaaaaaaccgcacagctcctcacagaacgtgaagaacagggagggctcgggattccgggaacggcgatggcgctttaccatctcaaaaatgaagaaattgtcacgccttttttcaaaatttatgatttgacagctccatgcagtgtcaaaggcatggacggaaattccctgaccgtcgaccgcgctttggtgatgatggcgccggctgatatgcccgctgaaggctcggaaatattaagtgcggtcagttcggccattattgaatccgaagccagtataaaagcctttcagacagaggatgaagccgatttatacaaacgtttaaacaggctgttttatcatttcattcaggagaaaggacagcgctgaacaggaagcgcacgcctcataaggcgtgtgtttttttccgtatgtatgagggtaaagtgaagggaggaaactaaaaacacgggactattgtatcattcaccgatggaatagttctaaaacaaaatagttttacaagttatattttttggtttaaaatgggttgcgtgaggaagaaaatctgacagagtttttttgatttatcattatgggagatgaaaatatgaagacattacagcatctgattctgcatgacatttcaaatagcgaagagatcgaagctgtaaaaagcggtgcgcacaccctgacctacgcggaatatcgaaaacgaatcaatcagcttgcacaagcgcttcttgataaaggaataaaaaaaggcgacagagtggcgatgctttgcaaaaacggccacgcttcatccatcgttatgtttgctgcacttgaaatcggcgcggtggttgtgccggtcagctggcaattaacaccgtatgaaatgaaaggcattttggcagcctgtgagccgaaagctgttttttacggcactgaatttaaagagattatggaagaggtgcttcctgcgcttgaatcttcccttaaactgaaggtcgtgacaggaactgctgtagagacaacacctgagtttgatgctttattgacaggctccggcgatacaccggacgtcgaaacagtgtctgaaaacgatacggcattgctgatgtttacctcgggtacgaccggcaatccgaaacgctgcatggtcactcacggcggcatatacaactacgtaaatgcgacattggcatacacggggagaatgcagcatgtccgtttcttagcatgccacccgaattaccatacgagcgcgattatttgccagatggtcggcacgatgagcggaacgacattcgttatgacagacaatcaggaccctcttgaaaacttgaagctcatcgaaaaagagaaaattcaaaccgtgatggcgctgcctgtttattacacatacctgctgaaagcatgggaaacgcatcagactgacatatcttctatcgtttatatgatgacgggaggcacaaaggtgccaagcagcctgatccagcagtatcaggacatcggcattccgctcatgcacggatacggaagcactgaagcatggggcatcagctcttggaatccgcaaatgggaatggataaagccgcttctgcgggtaaaccgatggaagaagtggacgtccgcgttgtagatccggaaacaggagaagtccttccgcaaggctcaatcggagaagtcgttgtgacaagtccgtttttattcaaaggctatgaaggtaacgaagaagcgacacgaaaagtgctgaaagacggctggttccataccggtgattccggatatgttgatgaagacggatttatctttatcaccggacgttataaagatgtcatcatctacggcggcgataatatttatcctgaccagattgaagaggtcattcagcaagtgccgggaattctcgaaacggctgttgtcggtatccctgatccgctttacggtgaaaaaccgaaagcgtttatcgtgacaaacggcagagaaggcctgacagaagaagaagtgacacgattccttcaagaacgtcttgctgcctttaaaattccggaaattgagttcgtcagcgaacttccgaaaaacaaccttggaaaagtgaaaaaagacgtgctccgcaaacaagcggtccgttcataattgaaaacaaaaacccggctgcccgccgggtttttttcgtgcgttccatgtgaaacatttttctccgaaaacgttttgaactgtttcaattatgtttatccggcagacagccgaggtagacatgaagtaagacatcgaacaagaaggaggaacttgacatggaaaacaactatccgaaggaattcccggcggaatcacaaaaccgccagccggcattgagagcgaaatgaagccggcgcctgtttacgaatacaaagaatataaaggcgctgataaattaaaagggaaaaccgcgcttatcacaggcggtgacagcggtatcggccgcgccgtagcggttgcttacgcaaaggaaggcgcaaatgtcgcaatcgtctattttgatgaacacggagatgcggaagatacaaaaaaacgtgtggaggaagaaggcgtaaaatgcctgttaatctccggcgatgtcggtgaggaagacttttgtaacgaagcggttgaaaaaacggttgaagaattcggtcgtctcgatattctcgtgaataacgccgcggaacagcatcctaaagaaagcattaaagacataacaagcgagcagtttcacagaacctttaaaaccaacttttactcacaattttatttgactaaaaaagcgattgattacatgaagctgggcagcgcaatcatcaatacgacatccattaatccgtacagaggaaatccgcagctgatcgactatacggcaacgaaaggcgcgattaacggttttacgagatcaatggcgcaagcgctcgtcaaagacggtatccgcgtcaacgccgtagcgccggggccgatctggacaccgctgattccggcgacattctcaggagaaacagtcgcttccttcggccaggatacgccgatgggacgggccggccagcctgttgagcatgtcggctgttatgtgctcttggcttcagatgaatcatcctatatgaccggccagacgctgcatgtcaacggcggcggatttgtgaccacataagggggctgaagcatgacgatatcgaagcatgatgtgaatgcatactatcaaaaagcgggaatcgttctgaccgatgatgaagtcgaagacattcaaatcatggattatggcttaggcaagcttcaggaaacagggcttcagctgtttatttacgtgaatacagaccgttactgttcgaaagaattggtgctctttccgcgccagacgtgtcccgaacaccgccatccgccggtcagcggcgaaaagggaaaacaagagacattccgctgccgctgggggaaggtgtatctctacgtggaaggcgaaaagacagaacacccaagcgtcctcccgccggaagaagataaggaatactacactgtctggcatgagattgtgcttgaaccgggcggacaatacaccattcccccggatacgaaacattggtttcaagcgggagaagaaggggcggtcattacggaaatgtcatcgaccagtacggatgatcacgacattttcaccgacccgcgcatttaaggatgaggctgcgcgcctcatctttttttgtatggaaaaaaatgaatttacctgtataatggctaataaaggaaaggaggtgtgatcgtgttttcctgtcaaatccgggaacatctgacgatcagattgcttgccaaagaagatacggacgaattgtattctgttataaaacgaaatcaaaaccatctcagcgaatggctcagctgggcggaagaactggctgatatcgatacgtaccgcgatgtgatcattccggaatggcgttataaatacgccgaagagaatggtttcgacgccggcatttttgtgaagggccggttttgcggcatgatcagtatccataatgtcgatgcagccaatcaaaaagcggacatcggctactggctggatcaagagcatgaagggttcggcatcatcaccgcgagctgccgggcagtcatttcccatgcatttcaggatctcgggctgaaccgaatcatgatcagcgccgctgaaaaaaacacgaaaagcagggcggtggcggaacggctcggatttcaaaaagaaggactgacgagagaaggcattttcgtacagggcgcctatcatgacgcggtgaactacagcatgctgaagcgtgaatggagcgaagatcggcagaagagcacatttcttggtttaaatgtctccccgatgtggaaaagtaacagcggagacgttaaaaaggagtgattcttcatgaatcagaatgaaatcaaacaaaaagtgctcgaagtgctggatcatcataaagtcggttcgcttgcgactgtagagcaaggcaatccgcattcccgctatatgacatttttccatgacggcttaacgatttacacgccgacaagcaaagacactcataaagcggaagaaattgaaaacaatccgaatgttcatattttgttggggtatgactgtgaaggattcggtgacgcttatgtggaagtagccggaaccgcaaaggtcaacaactcagccgatttaaaagaaaagctgtgggatccgaaactggaacgctggttcgacggtaaagacgatccgaatctggtgattcttgaaattgaaccgaagcagatcaagctcatgaacgcgggcgaaaaaacgccggccgagctggaactttaataaatcatttgatcattcaggggcaatctgttatacttaactgctaagtgacaacatgcaaataaaaaagaaagtaaacttcttttttctgttttgataaagaagcttcaggcttcaacggacagcttgaaaaaaagctgagcttattcttttccttctgaaattcgcccctaacgaagagatggaaaaaagactttttgttttacaattcacaccggcgcggcttcggagccgcagtgacgattgagaggtagggctttcgttgtcttgtgttcaagaacttccatggtgtttactttcgaagaatgattctgtcggaactgtaatgtacgaatcacccgcgggctaaggcgggaaaccatatattatttatttgcgtaagaaaagaataagacaaaaccgcaccggacatccgggcggtttttttatttggccggccgaaacctcgccgcagtctgcagagtctaatcagtatgaaaagatttggaggaatcatacattgcacgttattacttcacaagtactgtttatcttctgttttctgctgttgatacattcgattgaaacacttgcatatgcgacacggctttccggcgcgagagtcggatttatcgcgtccgcgctgtcattatttaatgtcatggtcattgtgtcccgcatgtcaaacatggtccagcagccgtttaccggacatctgattgacgccgccggatcaaatgccctgtctgttgtgagcgcccagtttcgctttttaatattcggctccacggtcggaacgatgctcggcatctgcctcctgccgacatttgttgcgttatttacccgggcgattatacatttggcggacggaggcggctccgtcatgcaggtatttaaaaaaggattttcactgaacgggctgaagcaggcgcgttcttatatcagattgccgtcagtttcctatttaaaagggcttcaattccgaatgatcccgaagcgcttgtttgtcattaatatggttattacgtctatttacacgatcggcgtactgtccgctctgtacgccggccttctggcgcctgagcacagcacgacggccgtgatggcatcaggattaatcaacggggttgcgaccatgcttctggctgtgtttgttgacccgaaagtatccgtactggcagatgatgtcgcgaagggcaagcgaagctatgtttccttaaaatggacatcattgacgatggtgacgtcaagggtcgctggcacgcttctcgcccagctcgttttcattcccggcgcgtattatatcgcctgggtgacgaactggctgtaggtcatgcaaaaaaagctcctctataaaagaggagctttttttatttataatttctcaggccgcggtcataaataaaattgccgaacgggataaaagccgcgataaaaccggcggctgaccatttcacatgccatttgacagtgaacgccgcatacgccagcactgccaaataaataataaacaacccgccgtgaatggatccggcaatggtgacggcgagcggatgatgtgcccaatacttcagcggcatcgcgataaacagcagcaccaaaagcgacatcccttcaataaaccccatcgtgcgaagcctgccgatcggcgtgtgtaacatacaactccctcctgtcggacatctgattttctatactataagcaatgggcagtcctaatatgaccatttcgcgactgtttctgaaaaaccttcatgatttcagcctgttgttcttgtcattttacggatttctcttgataatatagccaaaagggtaaggaaggactacagtcatgaaactagataatgttgatctgagcatcattaaagagctgcagcgggacagccgcctgtccatgcgggagcttggaagaaaaatcaaattgtcagccccgtccgtcacagagcgtgtcaggcagcttgaatccttcggcgtcattaagcgctatacattggacattgatcaaaaaaagatcgggcttcccgtttcctgcattgttgaagcgacggtgaaaaacggaaaatacgatcaattcaaaacctacattcaatccattcccaacattgaattttgttttcgggtcgccggcgcggcgtgttatatgctgaagattaacgcggacagcctggaaacgatcgaacacttcattaaccgcacctctccgtatgcccaaaccgtgacccacgtcattttctcagaaattgacacaaaaaacgtcctcgattagagagagcgtgaggaagtctgttataataacaggatgagtgtgaaagaaagagaagtgaaaaagcatgtcaaaaacagttgtattagctgaaaaaccttcagtcggccgggacttggcccgcgttctgaagtgtcataaaaaaggaaacggataccttgaaggcgaccgctacatcgtcacgtgggcgctcggacatctggtaacgctcgctgatcctgaaggatacggcaaagagtatcaatcatggcggcttgaggacctgccgattattccggaacctttgaagctcgtcgtcattaaaaaaacaggaaaacagttcaatgcggtcaaagcccagcttatccgaaaagacgtcagcgagatcgtaatcgctacagacgcaggacgggaaggggagcttgtggcccgctggattatcgagaaggcaaacgtccgcaaaccgattaaacggctgtggatttcctctgtgacagataaagcgattaaagaaggattccaaaagctccgcagcggcaaagaatacgaaaacctgtatcattccgccgtcgccagagcggaagcggattggatcgtcggcatcaacgcgacccgcgcgctgacgacaaaatttaacgcgcagctgtcatgcggacgcgtccagactccgacattggcgatgatcgccaagcgcgaagcggatattcaggcgttcacaccggttccttattacggtctccgcgcggcggctgatcagatgacgctgacatggcaggataaaaaaacaaagcagacaagaacgttcgaccagacggtgaccggccgtttggcaaaagacctgcaaggaaagccggcagtcatttcagaattgaaaaaaacagcgaagaaaagcttcgcccccggtctttacgacttgacggaattgcagcgggacgctcataagcgcttcggtttttccgcaaaagagacgctgtcggtgcttcaaaagctgtatgaacagcataagcttgtcacgtacccgcggacggattccagattcctttccgcagacatcgtgccgaccttaaaagaccgattaaacggcatggaagtcaagccgtacgcacaatacgtcaatcaaatactgaagcgcggcgtcaaagcgcataaaggattcgtcaatgatgccaaggtatctgatcaccatgccatcattccgacagaggagccgctgattctttcaagcctcagcgacaaagaacgcaagctgtatgatctgatcgccaaacgttttctcgccgtgttaatgccggcgttcgaatacgaagaaacaaaggtcacagccgatatcggcggcgaaacatttaccgcaaaagggaaaaccgttcaatcgccgggctggaaagccgtgtatgatatgtacgaggatgacgacgatcatgaggaagacaaagaccagacgctgccggctcttcagcagggtcagcgcctctctgtctcatcattgaaagaaacgagcggacagacgaaaccgccggcgcgctttaatgaaggcacgctgttatccgcgatggagaacccaagcgcctttatgcagggagaagagaagaaccttgtgaaaacgcttggcgaaaccgggggactcggaacggtcgccacccgcgctgatatcattgaaaaactgttcaacagctttttgatcgagaaaaaggaaaaagacattttcatcacgtcaaaagggaagcagctcttacagctcgtcccggaagatttgaaatcaccggcgttaaccgccgagtgggagcaaaagctctcctccatcgccgctgggaaactgaaatccgccgtgtttattaaagacatgaaatcatatgcgggcaaaacggtgaaggaaatcaaaaacagcagccaaaccttcagacatgataacatttcaggcaccgcctgccctgattgcggcaaaatgatgcttaaagtcaacggcaaacgcggcacgatgctcgtgtgtcaggatcgggagtgcggcagccggaaaacggtggcgagaaaaacaaacgcccgctgtccgaactgccataagaaaatggagcttcgcggccagggtgaaggccaaaccttcgcatgtgtgtgcggccaccgggagaaattatccgtctttgaaaagcgcaaagcgaaagataaatccggacgcgcatccaagcgggacatcaactcttatatgaaaaaacaaaacaatgatgagccgatgaacaacgcgctggcagaacagctgaaaaaactcggcctggataaataaatgagagaaaggcagcatttgtaaagaaatgctgccttttgtcgtgttttttactgtattgggaatacaatccatacaaagagggaaaaggggagcaggcggcgctcctatttttaaaatttaccaatgtgaaaaaatgctagtattctttgatcgtttcttatatagtaaaaatactttgtggaaaaataagatataggtataaaaaaggatttgtgaactaggaggatagactgtgaagcgtttcggttttagtttgatgatccttttgatttcgatcgtgctgacggcaggatgcacggaggccggcattgaaaaacagacggccgttgaaccgtccgaaccccttcagcccgcagagcattttatttatcataaactgatgaacggacgcggaatgatcaagacgaacatatccggtgaaccggaatatttatctgagtctctcggactatggatggaatttttgctgagcaggaaagatgaacggcagtttcaagcccagtatcagctgctcaccgattcgtttcttatgaaaaacgggctcgtgtcgtggaagattgaccggaataaagcaagcggcaccaatgccttaattgacgatttcagaatcatgggttgtctgaatgaggccgcatctctgtggggaaacagtgaatacgggaaaacagcggtgcaaatcgggaaggcgctggaaaaatacaatacgaatgacgggtattttacggattattatgatgccgcttcacatgctgcatcaaagaccgtgacgttgtcttatgtcagccccggcgccttacagatgctgagagaacaggggattatcgatgagaaaacggaaaaccggaatcttgatgttctcaatcttgcacccctgaaaaatggctttctgccgaaatcgttcaataccgaaacaaaggaatacaaatatgacagtgaagtcaatgtcatcgaccagttatatgccgccgtgaatctgaaacggggcgatgacaaagccgccgcgctgtcaaaatggatcataaatgaatttaagtcgcgcggacagctgtacggacggtacagcgcagacacgaaggagccggctgttcaatacgaatcaccgtccgtttacgccctggccgttctttttttaacagagcaaaaagctgatccggctgtcatcaagccgctttatgaaagaatgacttcatttgaaacgctggaaacgctgaaacctgattacggcggctatatgagcgggggcgatacacattctttcgataacctgctgccgcttctggctgaaaggaaattgtttaatgaaaatatcattcaatgaatcacaaaaactatgcagctacacagctgtgatgacagtgctgctgtcattttttatttactatgtgtcacagcaatcctcagggcttctcatgacctgtataacattgcttgtcgcgggagccggcttatggtttggggcgatctacgcgctcgtcatcactttactcgtcttatttgttctcggcagcctgctcctgtggtttcagaccgggagttttatggcgtctgccggtgccgaaggtctgcagatgctggtcgtgtgggggatcgcgctgctgctcttttcctacatgtcgggaagaatacacgatttggccaaggggctggatcgctcagttaagcagctgcgggaagagatcacgagctttgtggccgtcgacagggtgacgggctttgacaatcatctccggatgaagctggaactctctgaggaaatcaagcgggcggaacgctacggcaattccttcgtctttttgctgctgcacatgcattatttcaaggaattcaaatctctctacggagaaaaagagaccgaccgcctgctggcatttatcagccgccaaatccgttcaagcgtacgggaaacagacaaaaaattcaggccgtctgccgaacggttcggcatcgtgctgacccatacgcctgaagaaaacatgccggccgttctggcgaagctgaaaaaggaattggatacgtacaggctgcaaaacggtaaatacgtctcaatcactttccgtgtatgctatttggcgtaccgaaaggatttaaaaacggccgatcaatttttaaatgaactggaaaacgagatgatgatgaatgaactctaaatggatatgtctcttattggcggcgctcttcatggtttcggcggtttatgttccccgtacggcggaagcaaaagacaaaaaggacggcattctcattatttatacaagcacggacggcgaagaaaccgctgaagtcaaaatgcttgatttgatcgcgggccatttctcatccgccgtcaccgttaaaagcgacggagatatcacagccgctgaccttaaaaaaaatcggcgagtcatctattacggcgtaacgaagaaaaagctcagcaatcattttgtatctctgatcagcagcatgccgcagcagctcatcagcatcggctataacgccgggcagttccgccaatttacgggtttgtccctgacagaaaaagaaacggtctaccgcatatacggcaagaaagaaaaaacagacatgccgcttgaaaaaggaatgtccgtgctcggcgtatcaggagtaaaaggggaacccctttatacataccgatccggtgacggcagcacccgtccttttatatggaaaacggcgcgctctgactgctatttcggtgtgaccagcctgttaaatgattcgtttctgacggcgaaagaactgcgtaaggcgttcggagaatcagagggaagcaccttcctttatttgcggcttgaagacatcagcccgatgtcggatgaaacattgctttatcaagcgggcgcttatctgcataaaagacacattccgtttattctggcggtgattccggtctatctcaacccggaaaacggagaaaaagtatatctggcggacaagccgaaaatggtaagcgtcctgaaaaaacttcagcaaatgggcggcagcatcattatccacggctatacgcacgcataccggtacagtgaaacgggggaaggctttgaattctgggatgccaaagcggatcagccgattacgtcggaaaatgcggacgatactccggtcaagcttgaaaaggaacaggattttccgaatgaaaaagcataccgggcgtatgtgaagcctttccgtgaaaaagaaaaaatctatacgagaacgaagctggagcaggcgattgacgatctgacagagctcggcctttacccgctgtcattcgaagcgccgcattatacgatgtctgaagaaggctacaaaatcgcgtcttcttatttctccagcattttcggccaagtccagctcagcggcacgacgtggaaaacctcgggcgcccctccgtttgtcacaaagccggctatgctggacgggatgacgctttatcctgaaacaatcggctttgccgataactcaaaggagaacccgctcggagatatggagaatcgcatctcccggatgattgatttcggcggcggtgtggcgggaggtttctaccatccgtatctcggcatgaaataccttcccgagctcgtcaatcaaatggagcggattcccgacggagagtggcttgatctgaagaaaacgaagcaaacggtgacgtcggcgagcgtcaggatcaaaacggacggagacggaaccattcatgtggaaaacaggattcatccgataacggcctttttcaatcaccatcagcagacgcctctggaaaaagcgctttggattctctccggcgtggtgctattgtttatcatcatgttcgtctgctacgtcctttatttgcgcgccacattaaaaaaacgaatctttaaggagagaagaagccttgagtaacattctgttttttatctcattaagtttaatatgggtgatgcttctctatcacatgtttctgatgcagggcggattcaggcattatatgaccttcgaacggaacattcccaagtggcgcgcaaaaatgggggagctcccgaaggtcagcgtgctcattcccgcgcataatgaggaggtcgtcatcaggcagacgctgaaggcgatggtgaatctgtattatccgaaagacaggcttgaggtcatcgtcgtgaatgataattcctccgaccggacgggagacatcgtcgaagaattttcccgtcagtatgacttcattaaaatggtcattacaaagcccccgcacgccggaaaaggaaaatcttcagcgcttaactccggtttcgccgaatcgaacggagacgtgatctgcgtgtatgatgcggacaacacaccggaaaaaatggctgtgtattacctggttctcggtctgatgaatgatgagaaagccggagcggttgtcgggaaattccgtgtcatcaacgcggccaaaacgctcctgacgaagtttatcaatattgaaaccatctgctttcagtggatggcgcagggcggcagatggaaatggttcaaaatcgccaccatcccgggaacgaacttcgcgatcaggaggagcattatcgaaaagctcggcggctgggatgataaggcgctggcggaggataccgagctgaccatccgcgtgtataatctcggctatcacatccgctttttcccggcggctgtgacataggagcaggagcctgaaacatggaaggtctggtggcgccagcggacaaggtgggcgcgcggcaaccaatacgtggttctcaagtttttatcccaatttttcaagctgaaacgcaagcggattatcttcgatttgttttacttcttttttacgtattttctgtttttcttcggtgtgatcatgtcaaacacgatttttatcatcaatcttttttacgacctgcatctggcagtcgggtttttggcgatgattttgtggatactggcctttttcctgtttatgaccgaggtcatgattaccttaagcattgaaaaaacagaaatgaacaaacaaaacttctttatcgtttttctcatgtactttacctactcccaggcttggatcgtgctcgtcatctggtcattattcacagagattaagcaccgcttgttcaagcaggaagtcaagtggtacaagacggagcgatacaatcaaaataaaagcgggtgacctttttgaaaaaagcgatcatattgataacaggccttttgctattgatgtataacgggcagacggccgcggctcaggaattaaaaacggacggttccgccctcggaaaaagcgccggcgcaaaagagcagcaggcgctgacgggtgatctgatgacactgtacggggcgaaagacagctcagaactgacctaccagattcctgcgggggcttcagatgccaatcagtcgcttctgattgattacgaggcgtcaaatttattaattgccccgtcttctttaaccattgccattgacaatgaacccgtcaaatccataaagcttgacggcagctccaagcggaaaacggtaaagctcaatctcagcaaaagccaatccgcccaaggctatcacaatgtatcattgcaattttacggtgtattaaaagagggtgtctgcgtcaggcaggatacgtcaggcaactggataaagatttatccggacagccgccttatgctttcagaagcaagcaagtccaagggagcggatctcagccatttcccgtatccgtttgcccaatcaggcaatacgggtgaagaaaccgatattatccttcctgacaaaccgacctcggcggaagcggaagccgcagtcaaaacagaaggatttctgaaaacggcggacagcaggctgaaagtatcatacgtaaaagaatccgatgcaggcaaaatcagcaatccgtcaattgtcatcggcgccggacatcattggaacggcaaaatcaaacagcttatcgaacggggaaatatcaaagcggaaggaaacaaactccttctcgcggaacgggtgctgaccgccggagacaaacgtcagcccgtcctgtttgtcacggcacaatcagacaaaacgctggcagataaaatccgcgtcattacagacagcgcttattcaggccagctgagcggagactcactgatgatcggccgtcttcagcccgctgctgaaaagacaggcaataaactgacactagacgatttcggcgcgggaaatgtaacggtcggatcaaacaaaacggcgtcagagcacttcttttaccctgcggcggccgctgttgataaagacgggcaggtcaagctttcgctcacattaaagacgtcggaatcggtccggacgaagacggattctaaagatgttgacgctgagagagcagagcttaacgtcatggtcaacggacagccgaatgcggtgcatcttgatgatctcggcaataaggataaagacgggttttatcacgtcacaattccgattgatccgaagcttttgcgaagcagcaggtatattgatctgcaatttgtcacatcaggtttgaaaaataacaatccgtgtatcgaccgtgacgaaaacaaatgggtctatattgataaaagcagcacgctgacttacccggtaagcggcgcgacgcaaaaaccggatttcgggcaatggccgctcccgtttgcaggtgacgtgaagaagaaaacagtgatcgtcatcccggataacgtaaacatgcagacacttaaagaactttctctggtgacggactcattcggaaacggcgcccgtcaggcatttaccgttaagacggcatcagatatgaaggaagcggacgccaaaggccggaatgttgtgtttatcggaggcttgccgcaaattccgcttttgaaatcaaacgcatctaagcttctcgtgccgtcagaccgaagcggcgcttacgatgtttcttcgtttcagatgctgaatgagacgacgaaacaaatcgcatttacacaggaatcaccttgggactccggctccggcatagctgtttttgctccgttatcaggaagcggcgcggctgtcacaaaagagctgatcagctttttagacagctcaagcgaagcggcaaccgtcatcaacgaaacgggcagcaagcagctgttttcgaaccatcagcaaatcaaatccgatgacagcagtccatcggctgatacgaaaaacccgtccgccgcaccgaacgtcacgtatatcgctgttttcgcagcgcttattctcattgcggccggtctgatatggctcacggcaagaaggaaaaaaagaaaaacgggcaatgaaaaaagtgaagaataatgaaaggaaaagaggctgttaacaggcctctttttctgtatttttatttccatttttgggggaggtttttttatttttgaaacagcataaaagcccctttacaaccggacgggacgggagtatgatctcttttataatctatatcgcttaatctgtatccagagcgggggaaccaatttgcggcgcatgatgccgcttggggtgaatcctttttcaggtagggccaactctcataagcccgaatccgacagctaacctcgtaagcgttcatgagaggagatgaatgaaacctgtgcacgattatggcgcaggggcatccgtttgcctctgtgtttttttgccgtgctgaaatatggcatgcaatcagcattcggagacatcatagcagtaagggtttgtaaatcaaacggaaaatgaaaaaaaggggaagacaacaaatgtaccattcaatcaaaagatttttgattgggaaaccactgaaatcacaggcggccggagagcagaaactgacgaaactcaaggcgctcgccatgctttcttcagatgcgctgtcatcagttgcttatggaacggaacagattctgatcattttggccacggtaagcgcggccgcgttttggtattccattccgatcgcttgcggcgttctcattttgctgcttgctttgattctgtcctacagacagattatttacgcttatccgcaaggcggaggagcttatatggtttcaaaagaaaaccttggtgagaagccgggcctgattgcgggcggctcattgcttgttgattatattctgacggtggcggtaagcatttctgccggaaccgacgccattacatcggcatttccggctctgcacccgtatcatctgttcattgctgttttgcttgtgattctgattatgattttaaatttgagaggactgtcagagtcggcgtccatactggcgtatcccgtctatctgtttgtggcggcgcttgtccttttgatcggcgtcgggctgtttaagctcatgacggggcaggttcatccggccgaacacacgccgatcggcacacccgtagcgggcatcacgctgtttttgctgctgaaggccttttcttcgggctgttcggcgctgactggtgttgaagccatttcaaacgcgatcccggcttttaaaaatcctccggcgaaaaacgcggcccgcactctggccatgatggggattctgctggcgatcttatttacggggattacggtgctggcgtacggatacggcacaggaccgaagcctgacgagaccgtcatttcgcaaattgccgcggaaactttcggccgcaatacggtgtattatttcattcaaggcgttacatcactgattctcgtgcttgcggcgaatacgggcttttccgcttttccgcagctggcgtttaatttagcgcgcgatcagtatatgccgagaatgtttacggttcgcggcgaccgattaggcttttcaaacggaattatctttctcggtatcgcatccatcctgcttattctattattcggcggccgcacggaacatctcatcccgctctatgccgtcggcgtgttcatcccgtttacgctgtcgcagacgggaatgtgcatcaagtggatccggcagaagccgaagggctgggccgttaaaatgctgatcaattcttgcggcgccgccatttcatttatggtgctgtgcattttatttgcgacaaagttcaatcttgtctggcccgtgctgttattcatgcctgctgtcgtcatgctgtttttcgtcattaaaaatcactacaccgcagtcggcgaacagctgcgggtcgttgatcagcagcctgaagaaattaagggaaccgtcgtcatcgtccctgtcgccggggtcaccaccgtcgtccaaaaatcaattcagtatgcgaaatcattatcggatcaggtcattgcggttcatgtttcctttgacagagaaaacgaaaagaaggtggaaaagcgctgggaagagcttgataacggtgtccgtctcgtaaccctgcattcctcataccgcagtctggttcacccgtttgataaatttttggaaacggtcgaacagaaagcaagaaaagaacagttctccgtaatggtgctgtttccgcaattcattacgaaaaaacgctggcagaccatcctccacaaccaatcagccttcttgctccgcgtccggctgttttggaagaaggacatcatcgtcgccacactgccgtatcattttaaaaagtaacatcaaagaccgcaggccttagtgccgcggtctttttttcgtcaaacgctgagaatgctacaggtgcacgtccccgtgtttcaacccgttgtaaaaagggcatgaatacaggtaaaaggaggatgcagtatgccaagtaaaacagcaggacatgtaatgacagagctgcttgaacaatggggagtcggtcatatatacggcattcccggagacagcattaatgaatttatcgaagaattgagacatgaacgaaacaacctgacattcatccaaaccaggcacgaggaagtcgcagccctggccgccgcggctgaggcaaaactgaccggacagatcggtgtctgcctttccatcgcagggccgggggccgttcatctgctgaacggtttatacgacgccaaagcggacggcgttccggtgctggcgattgcgggacaggttgcttccgatgaaatcggccgtgacagctttcaggaaatcaaattagagcaaatgtttgaagacgtggcggtattcaaccagcaagtacatacggcagaagcgctgcccgatcttctgaatcaggcgatccgtacggcttacagcaaaaaaggggttgccgtcttaaccgtatctgatgatttattcgcgcaaaaaatcaaacgggagccggtttatacgtcgccgatataccttaaagctgatatagagccgaaaaaagagcatctcgtgacatgcgcgcaatatattaacaacgcaaaaaagccggtcattctcgccggccaagggttaaaatcggcaaaagaggagctgctcgcattcgccgataaagcggccgcgccgattgtcattactcttccggcaaaaggcgtcgtgcctgacagccatccgcactttctcgggaatctcgggcagattggcacaaagcccgcctacgaagcaatggaggaatgcgatctcttgatcatgctcggcacatcgtttccgtacagggattatctcccggacgatacgcccgccatccagcttgattcggatccggcgaaaatcggcaaacgctatccagtcaatgcgggaatcgtcagtgatgcggctcttgggctgaaagagctgacggaatacattgaatataaagatgacagaagatttttagaagcctgcaccgagcacatgaagcattggtggaaagaaatcgaaaaggatgaaaccgaagcgactcatccgctcaggccgcagcaggtcattgcccggcttcgggatgctgccgcagaggatgccgtcctgtcagtggatgtcggaacggtcacggtgtggatggcccggcattttaaaatgaagaagcaggactttatcgtatcaagctggctcgccacgatgggatgcgggcttccgggagccattgccgcaagccttgccgaacccggacggcaatccatcgccatttgcggagacggcggattttcaatggtgatgcaggatctgccgacggctgttaaatataaactgccgattacggttattattttaaacaacgaaaatttaggcatgatcgaatatgaacagcgagtcaaaggcaacatcgactacgtcacccagctgcaaaatgtggattacgccgcctttgcagaaagctgcggggcaaaagggatcaaagtgacgaaacacgaggaattggctcccgctttccatgaagcgctcaactcaaatgagccggtcgtcatcgacgccgtcatcggcgacgagccgccgctaccgggaaaaatcacctacggccaagcgaaaggcttcagcaaatacatgctgaaaaacttctttgaaaaccaaaaaatcgaaatgccgtctctcaagaaaagcttaaaaaggctgttttaaaagccggcgtttataaaaaataaacaggcagcatgcctgtttatttttttatttgttattaggccctctcatttactcagttgagccgtagtaaaagcccggctgtttgttctgttttttcaataatgtcatgtcggattatatggtatagttcaaccaatctccaagagaaccgcccatctttttatagaacctttgtgcacggtaattatcagctgcagttatccacgacatatgtgcatacccgttttcttttgtgaatgattcgcatcttttaaacagttcttgggctgctcctgtacctcttgcgttttctgccacgaataaatcattcattactgttattttatctgctttcgttgtgctaaaactaaaatataatgttgcaaagccaatgagcttaccatcttgttcagcaacgaattgaataccgctgttcttttcaaataacatttcaatcaaattatgtatatgttcaatcggcggtttaggtcttttataaaaatcgacgatatataaatacattaaatcggtcaattggtttatatcatagggttctgcgcttctgattatcaaatgtttccctcctcactctgtttattttattatataaaacttacaaaaacattcggaattatgcaatatctttattgggactgtcttattgatccattagttcttatcagttttactgacctctttcatgataaggaagtgctcagtagttcaaacctgcttggaagcttagaggacgggaaccgaaagtctatcgcattgaaatctgtggaaatggcatgaaatcagcgatggctgatcaaaaaacttatgaaggaccaccttatcagcaaaaacgggaaaaagaccggtggggcgacgtacaccataaagaaaggggatggattatccgtcatagcacagaagacaggcgttagcatggcaaccctccaaagcttgaacggtatcaaggacccgaacctgatcaaagtcggccaagtattaaagctgaccggttcggccggcaacaaaaggcaagaaatcatcttacacgttgccgccaggcgtttttaaagagacaagccttaactaaggggacggccgtaaacagattcaatcggctctggcggctctctattactacccggacaaagaggcaaagaataatgcaatagacggctattacggatcgaagacagcaaatgcagtcaaacggttccagtccatgtatggattgactgcggacggtatttacgggccaaaaacgaaagaaaaaatgttgtctcttctgaaataaatgaaacagccctttaaagggctgtaccacaattctatatatttcataaaaataaagaagtatatagaattgtggttcgtgccaatggtagaatatgtttgttggaaatgatatttcaaatacttgtaaagttgtgtaaaatttgaaggttaaccttacgaagaaatagtgaaacaacacattgcctggtaaacattgtttaaagcccaaatcctatagttcagttggcactacatgtcccgattttgtgacattatacactcaatagaaaagattaaaatatcccgaataattcaaaaaaggtgtttacaaaccttatttagttcctatatcttagaaaagaaggaaaaattattcaatagggggatactgatgtgaaaaagagtaaatttttacttaccaccatgttctctacaactatgttgatttccggtttaggattgggatttgggaaaagtgcacatgctgaaggatttccgcaacttactaatgaaaaagtccaaacggaaatacaggaaatgaaagatgccggcatgacaagtgaggaagtacagaaattctatgaaatgagtaaagaagagtatgcgtatgtacaagaacatgcggaagacttgtataaggattcccaaaaagaaatcaaagaattgaaagcctctggtcaaattgatgaagttcttcctaaatacgaggagcctgaatatcagcacaagaaccaaatcgcagcaaaagcgttaggtacaaaaggtgatgttcttacaagctatgaaattaattctggaagttggtctattggtgtaggacatgctgcgattgtttcaactaacaaatcaaaaacagttgaagcatgggcgaaaagctggagtcctataaaccaagatggagttcgcagatataataataactggggaagtaaaaagaaagtttatggtctatgggttaaaaagtcgaataacaataagtatataaatgctgcaaaatatgcggaaaagcaagcagataataaaaagaaatataatttcaacttttttaataaaaagacaactgctaaattttattgttctcaattagcttggcgttcttggaaaaaccaaggtattgatattgacaatgtcaaatgggacactgttgtaacaccaatggagcttgtaaaatccaataacacaacaatcttttatcacaagggttaacattgacaaaaacaatcggtgctgcaccggttgttttgtcatttcaaagggaggaaaaaatgaatagacttaagaccctgtttattttcatttgcatactgatagtcacaacctcttgtagtctcatcccaactgggaatgaaaaagaggaaagaagtagtaatagcaagactgcattaaagaatattgacaatgcaaaatttattgttggtttttctaacactttagataggggaagtgagattggggtttacagtgaagatggtactaaaatggatagcttggaattgaaagatggtataaatttcacgatgtcttcatataacaaaaacgatacgttcttctcatcaaatagaagcaataatcacttgatgatagacaataaaactggagcaataaacaaaataaatgaaaagagtttgtcgaaaacaactgaggatgaaggtgctttctttataaacagttctggcggttatatcatccatgacattaacgttggatatacagacaaagggctggaaagtgaactggtatattggaagggaaacagccgaaaaaacaagaaacaaataaagcttgacggagaacttggatcagcaatcgtcgctaaaaataaaatttatgtcatttcaagtgatgaagaaagtatgtccatcatttcaattaacctagagacaaataagcaagagaacaaggcatccataccgaataaagggatatacttcatggatgaaaaggatgcattccaagctctagatgaaaatacatttgtactggcagttaatgataacgtgaatgagaaagagaattctaagctcatattaatagacagagagacgcttaaggtaaaaaaagaagtcgagatggagaaagggtttcatcctgcaaaattgaaaatattaaaagatagcatcttagctgtttcttttgatgggaagctgcaggtgtttgataaaaaaatggttaagaaaaaatctttcgatttttatgctggggatgataacaaattaatgaatgatgttcaattcaatgacagagagatgtatgttttactcaaaaactttgatatccagcgtgataacaagcttggagatatcacttcttatgatttgaaatcaggaaaaaaggtaaaaacaatcccgctaaaagcaaataaagagtgggaaatcgcccggttcgaaattttaaaataagttggaggtgtttatattagcccgcttttgagccctgcatatatcatactcatcattcttccggcagcttctttcttgctggggataatagggtatttcatctttcaaaaagtatggactatggttgtcgtcgtattgatcctgtcattgatatttatgtttgttgtaataggagcagagccaacatttttagtttgggtgtttatcatgacgggagcctgccttatctccggttcaatcactaagactataatgaattttacaaagcgaaaatattaaatggaataatcataagagtgtacaccaaaaccataatcccaaaaatcccgcgacgaaaattgcgggtttttttcgttttcactttttgttcaaatagttataatattacaaaaatagagattagagggagaggtatatatggaccaagttttgccgtcgtcccaggttggtgtcaagatcaatgaatagtacaaaatgattcgtcagttcagtgtgcctgatgctgagattttaaaggctgaagtagaacaggaaatagaggagatggaagaggatcaggatttgcttgttttttattcattgatgtgctttcgtcaccaattgatgttagattccttggagccggaagacagatatagagatcgccccacagtcgacgaactgcttgagaaaatagaaaaaccgcaaaaaagacttacaggcctcttgaaatattactcattattttttcgtggtatgtatgagtttgatcataaagagtatgttgaagcgataggctattatcgcaaagcagagagagagttgaatgctgtatcagatgaaatggagcaagctgaatttcattacaaaatagctgatgcctattatcaaattgatcagcactttgtttccctcaatcatttaaaaaaagccaagcaattgtttgaaaaaagtcaattatacaaagtgaaagtgattggctgtaatatgatggttggtgctaacatgtacgatatgtacaggctgacggaggccgaatcatattatcgggaagcattaagtatcgtccgcggcttggaagaggaaaaagtgaaaagaattataggagtgatctttcataacttaggcttagtttatttaagagggaaaaatttgattgctgctgaagagaatttcaaaaaggcaatagacgtgaaagaacatattgatacagtgtatggggtgagatcattatatatgatggcaaatgtcctgtaccaatgtggtaaagtcaaggaagcgcgtttcttttatgaaacggctttaaatcgtgcccggacttctaatgaagaagaatatttggctaaattaaaaatcattaattcattatacgaggaatataatgaaacagcagtgaaacaaagcttaggttacttagaagagaaacgcctttggtctgatttcgcagagctaactgaaaaattaggtgactttcattttgagaagaggaactatgtagagggaagaaactttttaaagaaaaccatacatgcccaaacacaaatacttaaggttacggaggctatataatgaagaaacttttaattagctccgctttaatcggtattcttttcactggattattaagtgtgacaaatgtttatactgctgaattgaatgagtctggaactttttatatcgccgaaaaagctataaatatttaattgtactcccaattcagttccccgccttttaaggttggggtttttctttttaaaatctccaccggtgtttgtgcttatcccatttcaacatacgctgccgcatgaggttcttgaccgcttcacgtatagcctgtaatcctttaccggtttttctcttcaactcatccattgaggatttttcccgaagtgagtcatgttaaagataatccggtacattttttccgctcaaaatcattcattcgaattacctcctcgagtaaataatacaagaacgaacattcccttttcaatttgaaaagcagacagacaaaaactttcaggatggacctgaatccccctctaattatagaaggggattcagcaatcatccgtaatcttacaaaaaggcaagaagatgctttgcacgctatatcgaatttcttaaatcagtatggggtgcatcaatgcctctatgaatcgccaaataaggcgtttttttcataatatctttcacagcctcgctaaaacgatttcacaacattctgatctgaaaattgttggccaatcatttccgcctggcttacagagttgttttggatgacgattccagtatttaagcctccggatccaaacgctgtttttgaagcggtgataggggtgatggttaacgcgccgccgacattgacaactccgtttcctgataagttgttaattttaataggggaaccatacatactcttttctcctctcacttcaagctgctaactatatgtatgctgtcattttgaataagattaaacaacgcggcaaaaattgccgaaagctccggcaatttctcttttgctagggataatagagcatttcatcttttgaaaattttcattgatatgtttgttgtaaggggcagagaacgtttttcatttgggtgtctgtcttgacaggggtttgccttatctccggtaagataatttcaaggaaaaacaaaacaggctgtcgagaagatcccgacagcctgtttatttttgtttgcgtgaaagagcgaagaaaaacgggaaggcggaaccggccaataacgtaccgaataaaaacattcccccgatgaacacatgatagttcactccgccgatccaaagccccgtgattaaggaaacgatgctcaatgcgatcatcacaaagccgggaatcagacgtttcttacccgttgtccgataagcaataagagaacagaagatgccgatgacaatcggcacaatccacagataaaaaaggataaatactgacataagcaaaactccgattttttcttctatcataccaaaaacgcccggaaaaagatacgaacgagagccgacggccaaaagaaaaaccggccgagatgggccggtttttctaacggaatgaatcgtaaatcacaaacagattaagcgcgatcaccaaaaccgcaatcagccaggcgagagccgtaacccattttcggttcgtcaggacgcccatcaggcgtttgttgcttgtaaacataatcagcggcacaagcgcaaaggcgatgccgaatgaaagaacaacctggctccatacgagcgcttctgtggcgttgattcctgagataatgatgatcatcggaggaatgatggtaatgaaacgccgcaaataaagcgggatacggtaacggatgaagccctgcatgataatatcgcctgacaatgtgccgacagaagagcttgaaagccctgcggccagcagtccgatcccgaagagaattgctgaagccggcccgataaagtggccgaattgctgataagccacgtctaaatcctccacatacagtccgttcttgaagaaaagagcggccgcgacaatcagcatgcttgcgttaatcgcccctgcgattaccatcgcgatgagaatgtcaatcgtctcgaatttaaaaatctttttccgctcgttatccgtttttccgacgacacggcgctgcgtcagggcggaatgtaagtaaatggcgtgcggcatcacggttgcaccgagtatcccggttgcaagaagcacactgtccattccatcgattttcgggatgaacagcccttcgagtacggaagcggcgtcaggcttggcaaagaaggtttgcagggcgaaggcgatcaccacgacaaacagaagtccggcaatgcccgcttccagcgcccggtaaccccggcgctgaagctctaaaatcgcgaatgatccgatcgccgcgataatggccgcttcaatcatcggtatgccgaacagcagattgagcccgagggccgctccgataaactcagccagatcagtcgccataatcaccagttcaccctgtatccacaacccggcggatacccatttcggataccggtctctggcgatttccggaaggtttttacccgtggcgatgccgagcttcgcggaaaggacttgaattaaaaaagccatcaagtttgaaaagagaatgacccacaacagcatatacccgtatttcgaaccagctgagatattcgtagcgaagtttcccggatcaatgtaggcaatcgccgcgataaatgcgggacctaaaaaaggcagaagccgcttgaatcccttgcttttgccgtcaagtgcatcctgaacggcttttgattgcagtgattgtgctgagatgtctttgctcattatgtctcacctaaattccgatagatttttagctaaataacaaaaagtttcctagacgcaaattattttatctacatcataaatccgctattatgagttgtcaagctctttatgttcaataaccagtacattttttccccgttttatctatgatatgtatcccgtccgagaaaggtccgaaaatgcaaaagacatcgtttcggaatagaaacgacgccgttttcaaacgatgtttccccatgcgcggatcctttgagcgttctttaaaaaggtggaagagtacacttgcccataaaacgtcagaaccttccgatcgccggcactgaatggagaaaaagccggcacattgcctccgtgtgccgggtaaatagaataataatgaatctttcctttggaagataaaacctttctgtaccattcaaatgacctccggcaaaacctctgcttctctgaataaacgtttgaatccgcggtatataagtgattcaggaccaataaaccgcagttatttatcaaaacaaagaaaggttttatcatttgcgcagaaatgaagttggagcattagacttatttcagtcttcctggcaaaaaagtataataacgtcaggaaagctttccagccatatgataaaagagggggaattttcttggtacgtcgtttgtcggtcttttctttagctatgatttttgctgtttctttattcgcttttggcggctctgcatcagctgcaacttttacacctaaagctgaaccggacgtttccattttagcaagcgggggaacagtcggtatttacggtgctaacatgcgctcatgctcaaaggtcagctgttcaacgattacaacattctcaagcggtaaaacaattacaggtacttgggtaaccggagaatatgtacaaggccactacaccaactctaataaatggctgaaagtgacgtatgcaggagcgacaggctacgtgtccgtcaccactctgtcttattattacggtttataatcagaaaaacccccgttcttttcagagcggggtttttccatgtattccggtttaatttcctcgcttcgtttcatcatcgtgtttcatcagctgatcgatttcttccttagaagcgttttttttccactctttcgcctgacttgtcgcaatgggaatggcccgtccttcttcataaccctcatctaccatcgcattcgcgatttcgatcgcttttttcctcacaggttcctcgagattcttcaatgattgcggataatccttcatagaccaaggcatgtctatcactcctttatgaaaagtgtttcccgcctgaagaaaaagaaaaccgcctcatcaaaaagaatgacagctatttttacgagagaccagcaatttccgaataaaatataaaggataaagaagcaaatacagattgaatgcccaccacatcagatcaaaatcaccgataaatacccaaaaggcaatcgcttgcaggcctgaacaaaaggtcagcacaagtgatattaatgcgaaagggcgccataacgcatgtttccgtttataaagaaacaagctgtacagcccggttatcgaaatgaaaatatctaagggaaagaatgaccagttccaggccattatcatggcgttatcatagtctttaaacaccatgttttttggaatccactcaaaaaaagtaacaatccaataaacgataaatccaatatctgtaatgaggaagagaacctttaaccctttcatcatcagtttctgtccgtatgaacgctgatgccgtttgatgacgtttcactttcagaaataaagtttaaggtaacgacaccgatgatgatcagaagaacagcgacagcttttatgacagagaactgttcatggaagaaaaaaattccgataaaggaaatcagcacgatccccattcccgaccagaccgcatacgcgatggagacacttatatatttcaaagtcaaagtaagaaaacataggctgccgatataaaacaataataataaaatactggggacaagttttgtaaaaccatttgataatttcatgctgaccgtacccattacttcaaaaatgatcgctaaactcaaataaatccaatgcattcaacattctccttcattcgtattattcaaaattatacaatatatagaatttaaagaaaattaaacaacggaatgttttccggataaaaaacccggtcgggtaagaaaacaccataaaggtatactatgtacaaagacattcggaagggacgtgcaggacgggtgacagaagaacggacagacctggaaagacaattgaaagacattcaaaaatgggaaaaggcgcagcagagggtgatgttctggaaaacgctcacccgcctgccgtttcagcttttggacaagctgacacctcaatttattcagcggaaaatcggacgcattctcgatgaaacgggaacgtttattcagtcaggcggacagtatctcacatcagaaaagcgcattatcaaaaagtttcagaaacggctgccgcacggcacatgtcaaacgcttctcgatatccggaatgcaccgcttgccgtcatggatgaaatcgcagaagccatggcgcgcacaagcgtaaagaccgccacggtgcagggagccgcaacgggagtcggcggcgtgtttacgcttgcggcagatattccggcgatgctcggtctgtccttaaagacgctgcaggacatcgcgattgcctatggctttgatccgaaagacaaaaaagaacgcgtgtttatcatcaaattgctccagctggcatccagtgacgtcatcggaaaaaaagcaatcctgcgggatttacagcaatatgaccaaaacgaccaaatctatcagcgcattgcctcgcaaatccaaggctggcgggaagtcgtttacagctaccgcgacacgttcgccgcgaaaaaactgctgcaaatggttccggccgcaggcatcgtcttcggcgcatccgccaaccgttcagctttagaaagcattgcggaaacaggcatcatgctttataaaaagcgccggattctaaaacgcctgaaagatacagaatgataaaaaaccacccgaaaacacattcaatgtgttttctttgtttatgagttctgaaatcgggaaaccaacaaccaacaccaattaaaggaggaattcaaaaatggcacaagaaaacaaaatgagcagagaagaagcaggtaaaaaaggcggacaagctacaagcaataaccatgacaaagaattctatcaggaaattggtcaaaaaggcggagaagccacaagcaaaaatcacgacaaagaattctatcaggaaatcggtgaaaaaggcggagaagccacaagcaaaaatcacgacaaagaattctatcaggaaatcggtgaaaaaggcggagaagccacaagcaaaaaccatgacaaagaattctatcaggaaatcggcgaaaaaggcggagaagccacaagcaaaaatcatgacaaagaattttataaggaaatcggccaaaaaggcggaaacagacgcagcagctaataaaagcataaaaggcagacaacctgcagagcaaaagcgatccggcgcatcagctggatcgctttttattttgggaaaatcttgttctgggccgacgttgcggtacaataaatgaaaaaaggagttttcactcgtgtctgaaatgcaaaatttactcgccatcgccaataaagtcaaagaaaaacacgacaatttttcaatcgcggagatcaatgaccactgtgtgcgcctcgcagtgtttacgggagaatatgactggcaccatcaccctgactcagatgaatggttcattgttcttgaaggtgagcttctgatcgattttaaggacaaagaaactgcagtgctcaaagcaaatgacagcctgctcatcccgaaaggcactattcaccgtacacgctcatacgtcagaaccgtgaatctttgtgtcgagcatacgcaagcgaaaacagtcatcacagagggactgccatgctgatcaaaaagattgtatgtgaaacagacgttgcaaacgctgaagtatttgcgcaagcacagtcacggtggggagcattatcacgtgtaaatggcttcgtcaaacaggccggcggctggcggaaaaacgcagacggtctgttcatcgcagagatcatcagtgtttgggagaacagacaggcctatgatcattttatggagaacgaacatgaccgcatatacgaagaaaacgagcagaaggctgcgattctttcaatagaagtgatgctgtacgaagaggatgaacctttcattcacgagctgttacatcatccggacatccgatacgaacctgattggacagttgtgcgcacataaaaaaagcccttttagagggcttttttattttcgtccgggaagcgtgttgtggacataaggcgggacaggatccagcttagctatttcgccgtgcgctttcggttctttttcgtattcgaacggttcgccgtccggcgctttttcctgcagccaattctgttcagcgctttctccgccgtctgagaaatgaataagcttatgggagaatgactgtttttccagcgccttcgggaatgtggaaggaacaatcgggccttcctgtgcctctaattctttaatagccgcaagccattggttttggtgcatcgtgtcacgcgccagcaggaagctgagcatatctttcacacctttatcatcggtcatttcatacaggcgtgcgacttgaagccttccttgtgattcggcgttcagattggcgcggaagtctgccaagaggtttccgcttgcgacgatatagcctgcgctccacggaacgcccgtgctgctctccggcattgcgccgagccctgagacaatggcatggtgcgggttcatgccgcctaaaatggacccgatgaccggatcatccgccgctttttcctgctctgccagcggagcatcttctaacagtctcgcaatcatcgtcgcgatcatttcaacatggccgatttcttccgtcgcggtgtccatcaggagatctttatatttttcattgccgcgtgtattccagccctgaaacaaatattgcatggcgacggatatttccccgtattgcccgcctaagatttcctgcatcttttttgcgaacagcgggtcaggacgatccggtttggccggatgctgcagttttttcgtatgtgtaaacatgtctccatctccttttttatttgtccctacttacttccccgtcaggaaaagggatgaaacggagatgggcgtattggtcctgctaaggatcgcggcgcaaggataacagatcttccacaagcccgcggccgatcacctgctcatattgcccgtaaactgggtcgagacgtttcatccattttttcttttccgctttcgtcagcacgtgaatattgatggatgaattcttcttgatttcttcgagctggtctttattcattttctcagcggaggcttcgttccattccgttgtttctttcatcgcctccgttaagatggttctcgttttttcagtctgtgaattccagaaatgctcgtcggtcattacggcataaccgaggtatccgtgattgctgattgtcaaataatcttgaacattataaaattttttagaatagatatttgaaatcgtattttcctctccgtctacgagattgctttccaagagctgaaacgtggaattaaaggaatcctgccgcggctgcgcgccaagcaggcggtactggtcctcgatcacactgctcggcatgatcctgagcgcctgtccctttaagtcatccggtgtgaagatcggccctttatttgatgtgagctgcttaaacccgtttgtccagtatgccagtcctttcaaatgatgcttttctaaagatgcgaacaggcgggtgccgattttgccgtttaagccttcctgcacggccttatagctggtaaacgcgtatggcagatccaaaacaccccattcgggagagagtgatccgagctttgaggtggagggagcgatgaattgcacgtccccattttggagggcgtttatttcttcattatctgaatagaggctcccgtttggaaacacctctactttaatggtgccgccggacttttgatagaccaggtcggcaaacttattcgcagcccgccctttaggcgtgttttcagcaacgacatggctgaatttgaaaacaatttgatctttcaggccttcctgttcgtcatcataatacggatcttccgttgagaaacgatcatgaaagccgatgaataaagcggttccaataccgagtaccatcaggctgagacaagtcagcaagcttttcatcgaaaaccccctccgccattttctataacaagcataatcgggcgggccggtttcgtaaagagacggaaaggaagaggccaatgacgaaaaaaaagctcaccatccgctggaaaatcaccatactttcttatatcgtcgtgctttttacctttttgatcgtaggcatcgtgctgatcggcaatattcagcatacagaagagcgcgagctgaaaaaacggctgatgaataccgcgcggacggtatctgagatgacggatgtcaaacgcgctctcgagcagaaaaaacagagagaagacgtgcgccatgcggtcgaagaaataaggatcatcaatgaagcggactacatcgtcgtcatggatatggatcatatacgctattcacatcccgtcagcacaatgatcggaaagcgttcaaggggcgaggacgaagcagcggcgttcgccgagcacatttatttttctgaagcaaagggagagatcggcaccgccgtccgcgctttttatcccgtaaaagaccgggatttgaatcagatcggtgtcgtccttgccggtaaaacgctgccgggctttggtgaaattcttcttcagctgaagcatgaaattctgtttatcgttctgttggcgctcggcttcggactggcgggctcctttttgctggcccgccatatcaaaaaacagatgttttggctggagcctcatgagatcgtgagaatgtatgaggaacggaccgctacgtttcattcgatgaatgagggtgtcatcgcgattgataatcagcaccacatcaccatttttaatgaaaaagcgaagcagatattcaatgtcagtcaagatactgatggcagattgatctgggacgtattaaaagattcccggctccctgaaatcgttgagcggaaccaagctgtatataatgaagaaattcaagtcagcggaaaggtgatcatgagcagcagaattccgatcgtcatgaaaaagaaggtcatcggagccgtcgccattttccaggacaggacggaagcagcgagaatggctgaagaactgacaggcgtaaaaaattttgtcgatgcgctcagagttcaaaaccacgaacatatgaacaagctccacaccatcgcgggactgattcagctcggaaaatcagaaaaagcgctccagctcgctttcaaggcatcgtcagaacaagaaagcgtcactgaatttcttcatcaggccattcagaatgacgctgcggcggggcttttgttaagcaaaatcaaaagaggaaaagagctcggcatttctgtgaaaattgatgaaaacagcagcttctcggaatttccggagcatgtcgaccagcatgacatcgtcgtcctgctcggcaatttaatagaaaatgcattcggcgcatttgaaacagcggacacggaggacaaacacattgacatcagtatcgagcaaaatgatgaagtgcttgctatattaatagaagacaacggaagcgggatttccgatcagcacatcccgcgcctttatgaaaaagggtttaccgtcaataaaacggggggcacgggatacggattgtacctcgtcaaacaaatcgtcgacaaagggatgggcgtcattgaagtcgactcacagcagggacagggaacggcattttcaattttatttccgatgaagggggaggaatcattaaatggacatcaaggtgctgcttattgaagatgatccgatggtgcaggaggtgaataaagaatttatcaccggtgtttcgggattcagcgtcatcgccacggccgctaacggagacgagggaatcaggctcataaaagaactgcgccccgacctcgtaatattagacgtgtacatgccgaaaaaagacggcattaaaacgctccaggaaatcagaaaacaaaagctcgaagtggacgtcatcatcgtctcggctgcaaaagacaaagaaacgatccagcttatgctgcaaaacggtgcggccgattacattttgaagccgttcaagctggagcggatgagacaggcgctcgaaaactttaaacaatataaacgcaaaatcgaagagcatgacaccatgtcgcaggatcagcttgacgcgctgcttaaaattccgcaaaatcagtcccggaatctgccgaaggggttaaatcattttacgatgaatgaaattttgacctatatgaaacagcagacggagccgctttcagctgaagaagccgccaaagcgctcggaattgccagggtgacggcgcggcgttatctcgatttccttgaaaaggacggccagataaaactggacattcaatacggaggagtgggccggccggttaaccgctacaaattcgtccgttagccaagaccaaaaagaccaaaatgtccgttatgatcataagcttcccctcccttcatgaaaacgctatcatttgtacatagacacagcgagaggcaagggggagtagggatgaaaattttcaaaaatctcacggtgcaagtcatcacggcggtcatcatcggcgtcatcgtcgggctcgtatggcctgaggccgggaaacaaatgaaaccgctcggcgatacatttatcaatgcggtaaaaatgattatcgccccgatcatattcctgacgatcgtgcttggcatcgccaagatgggagacatgaaaaaagtcggaaaagtcgggggaaaagcatttatttattttgaggtcgtaaccaccatcgcccttattatcggacttctggtcgtcaatatcatgaagccgggtgaggggcttgattacagcaagcttgaaaaaggagatgtctctcagtacacgcaaaacgggggacagggaattgactggattgaatttatcactcacatcgttccgtcaaacatggttgacgcttttgcaaaaggcgatattcttcaggtcttattcttttctgttttattcggggtcggcctggcggcgctgggtgaaagaggcaaaagcattattgatttcttcgataaactgtcacacgtctttttcaaaatcatcggctacatcatgcgcgcggcgccgatcggcgcattcggggccatggcctatacaatcggccacttcggactggattcgatcaagccgctggcgagtctgatgctgtctgtatacattacgatgttcctgtttgtattcgtcgctttgaatatcatttgcagaatattcggtttcagtttgtggaactatctccgttttataaaagatgaactgctcatcgttctcggcacaagctcttctgagtcggttctgccgcggatgatggataaaatggagcgctacggctgttcaaaatcggttgtcggccttgtcattccgacgggatattcctttaatttggacggcacctcaatttatctatccatggcgacggtttttctggcgcaggtgttcggcgttgaccttacgatcggtcagcagattacgatcattctcgtgttgatgctgacatcaaaaggcgcggcgggcgtaaccggaagcggatttatcgtgctcgcctccactttgtcggcgctccaggtgatcccgctggaagggcttgcgctgctcctcggtgttgaccgctttatgagtgaaggaagggcgatcgtcaatctgatcggaaacggaatcgccaccatcatcgtagccaagagcgaaaatgaatttgacgaagtgaaaagcacacaggccgtaaaagaaatgaaaacggcggtataaaaggggaggaacggcatgcatcgggcatgccgttctttttttcggccgctatgagtaaaaaagataaatttgtttaaatttattaggaggtggacaaagaccttagcgtcattttgttatataatttacaattagagagtgaaagatgaaatctaagggctttttgtcctagcaggagtgtataaatggcggctatttttaaattttttcagcatccgggtgtcagacgtttttccgtttttcttgttttgactggggtgttagttgtattccgaagtatgattaatttgattttgcttacgtttatttttacttttctgatggatcggctggagactgtcatcaggcacgtgctgaaccattttttccggatcagccagagggtggtcattaccgttttatatattgcgctggctgtcggagcgactgtgggaggctttgtcttttacccgattgttgccaagcagattgaacagctgattaagcagatcaagcacatcgcgtatcatcccgatgtcatcccgttttatgaagaaatatcgagcgtgttcggcgatattaatatcggttcctatgtaaaagaaggatttaatgtactgtatacatacttggccgatatcagcactttcggtttgcaggtcgtgatgtcactgattctcagcatgtttttcctgttcgagaaaaagcggctcacggagtttatgaaaaaatttcagcacagcaagctgtctgttttttactacgaacttgcttatttcggcagcaagtttgcgagaacgttcggcaaagtgcttgaagctcaatttattatcgcgctggtgaactgtatcctcaccttgatcgcattggcgattctgcattttccgcagctgttcggcctgtcaatcatggtctttttcctcgggctcattcccgttgcgggtgtggtgatttcgctcattccgctcagtatcatcgcgtatacgacgggcggcgctgcgtatgtcatctacatcgtactggtcattttcgtcattcatgcgattgagacttacttccttaatccgaaactgatgtcagcgaaaacggaacttccgatcttttttacctttacagttttaattttctcggaacatttcttcggcatttggggcttgattatcgggattccgatttttgtgttcctgctggatattctggatgtcgtcaataacgaagaggtggaaaaatctgaaccggagccggataagacgtaacatcagctccgctcttcacgaatatatgacaaatgttataatgcagacagtgccttatgtacgggcactgtttattttttgtgaaaaaggaggaaggctgtatgactgagccgattttacatatcgaaggccttgacaaaacaataggcaaaaagcacattttaaaaaacatcagcttggatgtcaggcagggcgagatcatcggtttgctcggtccgaatggatcggggaaaaccacacttatcagaatcatcgtcggccttttaaagaaaaacagcggtacgattacaattaacggttttcagcacgatgctgatttcgaaaaagcgcttgaatctgtcggagcaatcgtagaaaaccctgaattctacccatatctgacggggtgggaaaatctgaagcactttgccaatatgcacaagaacatcaaggaggacaggcttcaggaagtaatcgagcgggtcgggctcgcaaatgccgttcacgacaaagttaaaacgtattccctcggtatgcgtcagcgcctcggcatcgcacaagccattcttcaccgtccgaagctgctcattttagatgaaccgacaaacgggcttgatcccggcggaatgaaggatttccgcaaccatttaaaagagctcgcggagcttgaagggacgagcatcctctttgcgacgcatttattgcgtgaagtggaggatctttgcgactgtgtcatcatcattcaaaaaggtgaaatcaaaacagaggtcgtcctgcgcggcgttgcggaaaaagaggaaaaagccgtcatcgacatccagccggctgacaaagcatttgaatggctgtccgaacagcaatttgctccggagaaaaacggcgggggcattaccgtcaccgtatcgaagaaggacatcccggcattaaaccgggcgctcgtcggacaagactttctcgtgtattccatcatgccgtatgcggaatcgcttgaggatgaattcatgaaagtgacgacggcgcttcaagaggagggggagacgaatgtttaaattgacagcaaatgagcatatgaagctctttaatcgtaaagtctcattagtggcgcttattctgatggccgttctccagtttattatggcgcttgtcattaaacggcttgtcatcagctccgggacggatgagaatttcatcggctacatggcgtacgcacccgggctgaatattctgcttgaggcattaacgatcgtgatcgcggcaacgatcatttccgctgaatttgataagaaaacgatcaaatttttgttaatccgcccggtaaagcgggagcgcatttttatatctaaactcattaccgtatttttggtcagcctgtacctgtatgcggcgtactatattctgtcactgcttttcggcatcgctttcttcggtatgtcggtgacatctgaatcagggacgctcctcgtgaacacgctgaaagtaatcggcacgaactgggttgaggcatttgcgatggcatgcttcggattgctgtgctcttccttattccgaaacagcgccacggctgtcattttatcatttatcgtgctgtacggcgcaaaatcactcgtgacgattatgtctctcttccaaaacaaatggggaagcttcctgctgttcgcgaatactgacctgacgcaatacatgagcggggcaaaaccgctgtttgcgggaatgacgccgttattttccgtgggcattatcattatccatatcgtcttcttcttagccgtcgcttggtggagtttttgcaaacgcgatgttcgggtgtaaagtaaaggaatgacatttttgtgaaaaagatcacgataaatcaataatttatgctattttgatttataataaaggtaatgacggaggtgctcacttgagaaattttattaccgcattaccgattgtgttattgcttggtttttcctttgtgtcattcatgttccaattcgaacatcttgtttatttcaggcttgcgctgggattgttttctacagtgggtctgtttctcttatataaaatgaagacgggattccgttatttcatcatctacctgtatgcaagctggatcgtgcttgcggcagttaccgcttttgaagagccgattttctcaagctttttctttggcgggcttgtgatgacgatgggttatctcacatatatgctgatctatctcgggctcaagcaggatcgcggcccggaagcagtctaaaacgcgctattctacggaatagcgtgtttttttgtacagcctcacagttgcggaacgagacttgaatctctataatacttattaactttatcggaattataatggggggattccagtgtctttatggatacagaacgaacggcagagagaatggatggaaaaaatcggccttcttgcagatgaatttcaaaaaacagccgcgcttgatgatgaagagggccgttttcccgcagagaaaattcaaagattgcgggacgcgggatatacggcgctaacggtacctgaggctttcggcggagcaggcatctcggtttacgatatggtgctgtttcaggaacggctggcgaggggggacgcggccgtagctctcggaatcggctggcatttatccgtcatgggagagctcggagaagaaaacagctggaatgaagatgtcttttcatttatcgcagaagaagtgaaaaagggagccgtcctgaacagggcagcgacagaaaagcagaccggcagcccgacgagagggggaagacccggcacttccgcggtgaaaaaagacggtcaatgggtgctgaacggccgaaaaacctttacaaccctttcactgactttggattatatgctggtgacggcatggattgaagaaaagcaaacgaccggcgtttttctcatccataaagaccaggcgggcgtttcggtcgaagaaacatgggatatgattgccatgaaggcgaccggaagccatgatctccttttagatcatgtcacggtcggtgacgagcggctcgtggagcttttcagcgggccgagaggggcaaaagtgaacggctggctgctccacattcccgctgcttatttgggcatcgctcaagcggcaagggactatgccgtccggtttgcatccgaatattcgccgaacagcctgaacggtccgattaaagacgtgccggccgttcagcagcgtgtcggggagatggagctggaattgttaaaagcgagacagtttctcttcacggcggcgcaaatgtatgatgacccaaaacgccgtccgtttataaaaagcgagctcggcgcggcaaaacacattgtgacgaatgccgccctttctattgttgataaagcgatgagaatcaccggcgcgaaaagcctggaacgaaataatccgcttcagcggtattaccgggatgcccgggcgggacttcacaacccgccgatggatgatgcggtcatcggcaaattagcggcggaagcatttgagcaataaaaaaagagcctgaaaaaggctctttttatgtatggctgttgtgctgaagccgtttttgatgcttacggtcaattctgtcatagatcacattcatcagcttttgattattcatgatggcggccttgttttcttttatcagctgttcgtaagtttttattttacgtttcggcatgagtccgcaccttccttacatatttgatattcgctttctagctctccaagcgataattcgtataaatgccgttccgactttttgtatattccgttattaatcagcaaatggatcagatgtttttttcgtccttcaactgatgatctgagttgaggagaagatctcatgattaccctcctatcaaatgatattgataatcattatcagttaatgaaagtatacaatgtgaatattcatatgtaaaggaaaaataccgccaatttttcgacaaaaagtttcccggggaataatgctgtcgaattgattgcatttccggcagatcaaaactgctatttttctgcttttccatccatactatgaatgagaatggaggcgtcttatatgaatgatcaaacggcaaacttaaaacggggcgaaaaaggcgcgcttctcaatatcgctgcgtacctcatccttgccgccgtgaaactggtgatcggtcttgtttatcattccgaagcgctcagagcggacgggttaaataatgctacggatattgtcgcatcactggctgtgctgatcgggctccggatttcccagcgccccgcggacagcgatcatgcctacggacattatagggctgaaacaatttcttcattaattgcgtcttttattatgatggcggtcggtattgaagtgctgatcggaggagcgaaggcggtcgtgagcggtacggagaccgagccgagcttcattgcggcttggacggcgctcggaagcgcgattgtaatgtacggcatgtatgtatacaacagccgtctggcggatcggatcaaaagttcggcgcttcatgcggcggcgaaagacagccgttctgacgcttatgtcagtattggggcgttcataggcgtcgtaacggcccggtttcatctgccgtggattgatccggtcattgcttttctgatcgggatcatcatctgcaagacggcatgggacatcttcaaagatgcttcccactcattgacggacgggtttgacctgaaagatttggagccgtacaaacatacggtgaaagaaataaaagaagtcagcaggctgaaggatgtgaaagcaaggtatttggggagcacggttcatgtggaaatggtcattacggtagatccgggactgtctgtgaaggaaggccatgaagtagctgatgaggtcgaatatgcaataaaacatgaacatgatgttactcatgtccatgtccatgtagagcctgaagtcataaacaaagatcgcggaacgaattaaatatgctgtgataaaaactcagtgacttcttcgggagttttagcgtttgcgctgtgaagatgcgctttcttttctccgtttttaaagatcagaaggctcggaatgcccatcacctgatatttgtcggcaagctcagggagctcatctctgttcaattcataccaatcattttgattatattcttccaaaatatcgccgatgaacatattcatgcgcgtgcagtcagggcaccagtcagcgaaaaacttcacgatgatttccttgtcggattgaataagttcattaaattgttctgttgtactgatttttttcatatgacacatctccttttccatgccattttaatataaaataaaaaggaattacatacaaatgctttcatatgcagaatgcccaaaaataattagatcattttctgaggaaaatgataagatagtaaagatgaattgttgtggggggaatatccattgaaaacaagtctaggattggtgtacggcggaaagtcagctgaacacaatgtatcgcttcagacagcacttgctgtaacaaaagcgcttaatactgataagtttgatatacatccgatttacatcacggaaaaaggagaatggcaaagaggtccgcttctgactgaaccggtttccaacgtgaaaatgctgcagctggaacaaaatggtgaaagtttcgctctttccgcattgaaccgggaaatgtttcctgaagcgtcggctgatgaaaaggcgccgattgacgtcgttttcccgcttctccacggaccgaacggtgaggacggcacgatccagggccttcttgaattgctgaacgttccttatgtcggcaacggagtgcttgcgtcatcagcgggcatggataaagtcatcatgaagcatttgttcgctcaagcggggcttccgcaggcgaagtacgccgctttcttaaaaaaggattggaaacagactccggacagctgcttacagcaggttgaagaggaactggggtatccatgctttgtcaaaccggcgaacctcggttcaagtgtcggaatcagcaaatgccgaaaccgcgaagagcttgaaaaagcctttgaactggcttttgagtatgaccggaaaattgttgtcgaagaaggaatcgccggcagagaaattgaaatcggcgtgctcggaaatgacgaaccgaaatgctccgccgtcggtgaaatcgcgccaaaaaccgatttttacgactacaaagcgaaatacgaagacggcgacacggatttaatgattcccgcgcaagtgacggatgaacaatacgcggaaatcagcgagatggcgattaaagccttcaaagcgattgacggctcaggccttgtccgcgccgatttcttcctgaccaatgacggtcaagtgctcattaacgaagtgaacacaatgccgggctttacgccattcagcatgttcccgctgctatggaaagaagccggcgtagattacagtgatctgattgaacagcttgttgagctggcaaaagagcgccatgccgagaaacagctgattaaacatacattttaatgaagactgacactgcctgtaggggcagtgtcttttcccgtaacagacaacattttttagaaagcgaggtgccacctttgataaagcgaactgtaaaacgaatcgccgacatggtcaaaggcacactgacaaatcccgtatttgaacaaacaatgatagagggcgccgcaaccgatacgcggactttggaaaaaaatcagctgttcatccctttaaaaggcgagcattttaacggccacacctttgtgccgcaagccttcgaaaaaggcgtttccgccgtattgtgggaccgctccgaaccaaatccgccgaaagagcgtgctgtcatccttgtcgatgatacgctggaggcgctgcaaaaattggcaaaagcttatttagaagagctcggcacacgggtcatcggggtgaccggaagcaacggaaaaacgacaacaaaagacatgcttcacgctgtcctcggcactcaataccgcgttcacaaaactgccggcaattttaacaaccatatcggcctgccgctgaccgtgcttgccatgcctgaggatacggaaattgccgttttagaaatgggaatgagcgcgagaggcgaaattgattttctgagccgccttgctgaaccggaagcggccgtcattaccaatatcggcgaatcccacatgcaggatttaggctcaagagaaggaattgcagaggcgaaacttgaaattataaacggacttcgggaagacggagtgctgttttatttcggggatgagccgctgctgcgcgagaaggcgtacacttgccggacaacgacatacggcgaaggtgcggacaatgatctccgcttgaaagaaataaagcaggcagaagaaggcacatatttcactatcgacggtattgatcgttctttctttattcccgttctcggccggcataatgtgatgaacgccatgggcgcatacgccgccggcatctatttcggcattacgccggaaaatgcagctctgggactgagccgcctgaaggtgacgggaatgagattggaactggtcaaaacggaaaacggcatctcaatcgtaaacgacgcctataatgcgagcccgacgtcaatgaaagcggcgatcgaattaattgaaacgatgaaaggctatcgaaagaaaatgcttgttctcggtgatatgcttgaactcggtgatgaagaaaaagcattccacgaagaatgcggggccgcgatcaatccggcggaaatcgaccatgtgtttacttacggcactctcggcgcattcattgctgacggagcacgcaaacattttgaagagggccgcgtcagccattatcttgataaaaaagaactgcttgaggctatccgggaaaatgccgcttcaggcgatctccttctgtttaaagcatcaagaggtatgaagcttgaagaaaccgttaaagatttattagagaagaactgaagaaatactgatcagcatcataaaaatccgcaaaaatgaagaaactaattcagggtgaaataattctgtccgtatgaaaaagaattaccgacggctggaaaatcccgcccggagcgggggccggcgtcatttgcgggaagaatccggtcaggccgcttccggccgcctgaccatctcgccttattgaaaaacacatagtgtaatggtaagattaaacgtaaagtaattcgggctttgtatacgtatgatcctgtcctttacatggaagggcagtttttagtggtaaatcacgacattactgaaacagcaatcagaaggagtttgaataatttgactataacgtttcaagatttccaattaagttctgatctcatgaaatcaatcaatcgtatgggatttgaagaagcaacaccgattcaggcacaaacgattccgctcggacttttaaataaagatgtcatcggacaagcgcaaacaggtacaggtaaaacagctgcgttcggtataccccttgttgaaaaaatgaaccccgagtctcctaatattcaagcaatcgtaatcgcgccaacccgtgaattagccattcaagtatctgaagagttatataaaatcggacaagataagcgtgcgaaagtgctgcctatttacggcggtcaggatatcggacgtcaaatccgcgcattgaagaaaaacccgcatatcatcgtaggtacgccgggacgtcttcttgaccatatcaaccgccgcacgatccgtttaaacaacgtgaacacggttgtcatggatgaggcagatgaaatgctgaacatgggattcattgatgatatcgaatctattctctcaaacgtgccgagcgagcaccaaacgctcttattctcagcaacaatgcctgcgccgatcaaacggatcgcagagcgtttcatgactgagccggagcacgtaaaagtaaaagcgaaagaaatgactgtatcaaacatccagcagttctacttggaagtgcaagaacgcaaaaaattcgacacgctgactcgtcttcttgacattcagtctccggaacttgcgatcgtattcggccgtacaaaacgccgtgttgacgaattagcggaagctctgaaccttcgcggatatgcggctgaaggaattcacggcgacttaacgcaggcgaagcgtatggtagcgctccgcaagtttaaagaaggtgcgatcgaagtgcttgtagcgactgacgttgctgcccgcggacttgatatctcaggcgttacccacgtgtacaactttgacgtgcctcaagatcctgaaagctacgttcaccgtatcggaagaacgggccgcgcaggaaaaacgggtatggcgatgacgtttatcacaccgcgtgagaaaagcatgcttcgcgcgattgaacagacgacaaaacgcaaaatggaccgcatgaaagagccgacgcttgacgaagcattagaaggacagcagcaggtgacggttgaccgtctgcgcacgacgatcagcgaaaacaacctgaacttctacatgacggcagctgcggaactgttagaagatcatgatgcagtgacagttgtggctgcagccattaaaatggcgactaaagagccggacagcacgcctgtacgcctcactgatgaagcgccgatggtcagcaaacgctataaaaaccagcgtacttctaagcgcagagacggccaaggcggcggctaccgcggcggtaaagggaaaagcagcaaccgttcttcctacgataaaaaacgttcaaacgaccgccgttcttcaggtgacagacgccagaaaaaatcatactaagacacagaaagcggacccttctatggggtccgctttttttcgatatgccggaaagtgaatcttttttgcaaatcagccgtatttgtatgtatgataaaaaatgggaggtaggtatattgagagcacagccaaaaaatcgaatcagtccaagcggcttaaaagtctggcgtcttcaggaagtcatcttgtccgccgtttgtcttctagcggtcataacagcagctgttttaagccatttcttccattggccgtattggatcacgggagtcctcggcatcatttggattatcgggtcagtgatatccatctatgccataccgaaaatcaggcacaggatatggcgttatgaagtccatgaaaatgaaattgatattcaatccggcatttttattgtcaaacgggtcattgtgccgatggtgagggtgcagcacgtagacacttcacaaggcccgctcctcagaaaataccagctggcctcagtcaaaatctccacggcggcaaccgttcattccattccggcgcttgatatggaggaagctgaccggctgagggattccatttcccgtctggcaagggtgacggaagatgatgtctgaaccgaaacgtctgcacccggcggccgtgattttgaacttattccatattattatcgaaaccattaaaaacattattcttcctttttttctcgtctatatcgtcaattccaaccatttcatccgcttttatggcggcattgcgctcgccgttctgctgatctggctgattacggcaagtgtgatcgagtggaggaagttcacgtatcggattgaagacggagaattcaggattgaagaaggcttattttttacgaaaaaaagatacatctccattgaccggattcaatcaatgaatacgagtgccggcgtcgttcagcagctttttaagcttgtgaagctgcaaattgaaacggccggcgacgggaaaaatgccgaggccgtcttatccgccattacggtggacgaggcggaacggatcagagcggctgtttttcagcaaaaagccgagcaagaagagcaccgggaaactgcagcggagcaggagcccgtgcgtgaggatgatgtgcaatccgtctaccgcctgtctttaggtgagctgctcatggccgcctcaacatccggaggaatcggtgtcatcatctcagcggtattcgccctcatttctcagattgatgaagtatttccgatggactggctctatgacagattttcttttctcaagcatgcgagcatcagcatttacgccgtgatcattttcgtgggtttgttcatcgcctggctgttaagcatcgccggtatgatgatcaagcatgcgaactttaaaatagagaaaaaggaacatgaattggtcattaccagaggaattattgaaaagcatcaagtgacgatgccgctccgtaaaatccaagccatcaaaattaaagaaaatgtcatcagacagttattcggctacgcgacggttgcgattgtcagcgccggcagtgcggggaatgagaaagaaggagctcagacgattctgtttccgatcatccgcaaatcaaggctcggtgtgatgctcaaggatttcaccccggattacgtgctggacgaaaatcggcatcatttgccgaagagatcgctgcgccgatatttattccgctccgtaatcttctcggttttcgtgatcattccgctttgtattctgtttaaaccgtggggatatgcatcgcttcttgtgcttcccgccgaactggtgctgggctatgcctcgtttaggagtgcgtcatggtgcttaaacggcggccggctgcagatcaccacgaggctgatcgggaagacgaccacgattatgctgagaagaagaatgcagatgttcgaagtcagccgatcctttctgcaaaaaagaagacggctcgcatccgtggctacagcggtgaaatcagctcaccatatggagcatgtcatgctgagggatgtcagcgaggaagatgccgaacgcatcgggcgatggtattcatatgaaaaagcggacggttaataccgccgctttttttgctgcacgcataaaaaagaaagcaaaaatccgcctgccagtccgaacaaatgcgccataatgttaatattagaattgataaacgtcgacagtaccgcaatgacaagcagggtcataatcattttcgactggtcccggccgatcagctccttgcggaaaacagtcagaaacacatacacgccgaaaagtccgaagatcgcccctgatgcgccgacatgcacataatcaagcggttcgacaagatacgtgccgatattgccgatgatgcctgatgcgatgtacacaatcagaaagcggacttttccgagcatttgctcaagcgggggcgcgaataaaaagagagacatggagttaaacagaaggtgggtgaaattcgcgtgtaaaaacatcggtgtcaccagccgccaccattctccttcggcaacgccgtaattatagccggtcactgcatctgaccacatcatgacggaatgaagcggcaggctgaaaaacagccacaagaacgcctgcagcgccaaaatacagctgacggccggataacgtctgataaaagtctggaaattttccgttcgtataaacatcgcaagcccctttgcatctgatttgttacatatatagtaacacgtttatgacataaaccgttttttagtacggacttttaggaggaattcacatgattttcggaatcggaatcgacatcgttgaactgcacagaattgaaaacatgctcagccggcagacgaggtttccgcaaagaatattgacggaggctgaatacgcccgttttacacagctgtcagacaaaaggaaaattgaatttctcgcgggaaggtttgcggcaaaagaagccttttcgaaagcatacggcacaggtatcggcaaagagctcagttttcaggatattgaaatcgggaaggacccggcgggaaagcctgtgctgacctgtgccaagctggacggcgcggcacttcacgtctccattacccatacaaaagaatacgctgcggcgcaggtcgtgattgaaaggttgtcacgctagtctgcatattagccgaaaccccttcatatatttgatagtgcattaagggagacaagttgtttgaggcttttatggtacgcgtccggccgttcagggcgtaccgttaaagtcaaacaagcgatttcttccctttacatcaattgagaagaaggggttgaaaaaaggtgagaaaaagctttgttttgcttttaacgggactgcttgccgtccttattctttcggcctgcggccaaaaatcacaggaagatattgtgaacggtttagataagaaggcgaaagaatacacctcgtacaaggcgaaagccaaaatgaccattcaaacggggagtgatccgcaagtatacaatgtggaaatctggcataaaaaaccttccctgtaccgggtctatctggaaaatccgaaaaaagaccaaaaccaagtcattttacggaacgctaacggagtatttgtcctcacgccgtctttaaataagagcttcagattccaaagcgactggccgaataacagcagtcaagtatatttgttcgagtcacttgtaaaagatgtgcaaagtgacaaagacgccgtctattccgccaaggataaaaagtacacttttgaaacgaaaacaaactatcagcacaacaaaatgctgccgacgcaagaaatcactttcaacaaaaaggacatgagcccgtcgctcgtcaaagtcatggatacagaccggaaagtgatggtgaaagtcgaattcaaaagctttgaattcaacaaaccgtttgacaaagattcttttgacgagaagaaaaatatgacgctctcccagatggacgtcgccacaagcgccaagccgtctgattcatttgcggtaaaaactccgcttcaattgccggccggcgtcaaaaagcttgaagaaaaagatatttcaacagcggacggcaaacggatcgtcatgacatacggcggggaaaaatcattcacgctcattcaagaaaaagcccaaatcgcaaaagccgcctctgccgtcacgctgaacggcgaaccggttaatctcggcttcacggtcgccgcgctgtctgatacgtctttaacgtggacatatgacggagtcgattacctcctgtcatcgaaggatcttaccaaagatgaaatggtggcagccgccaaaagcatgcagggacagtcatcaaaataacgtcaaaaaagaggccgccgctgtcggtctctttctttttttgatttcactttgcagaataattttagtatgataataacaatatggattgaaaataatgctaggaagtgtatcgagtgaacacagcatccttttacagagatacgtgggcggaaatcaacctgtctgcgattaaagaaaatattacacatatgaaaaaacacatcggcgaaaacgtccatctcatggcggttgtaaaggcgaacgcgtatggccacggagatttggaagtcgggaaagccgcgcttgaagcgggtgcctcttgtcttgccgttgccatactggatgaagcgatctcattgagaaaacgtggcattacagcgccgattctcgtgcttggcgccgtgccgcccgaatatgtacaagcagctgccgaatatgacgtaacactgacggggtattctgttgaatggcttcaggaagctgcacgccacctcggaagtgaaacagtgccgtttcacctgaaagtcgataccggcatgaacagactcggggtcaaaacggaggaagaaatccaaagcgtattaaaaatcctcagccaaaacccgggtttagtctgtaaaggcgtttttacccattttgctaccgcggatgaaaaaaacagggattatttccttttccaatttgagcgctttaaaaaattgattgctccgcttccgttaaaggaattgatggtgcattgcgcgaacagcgctgccggccttcgtcttaaaaaaggcttctttaacgcggttcgtttcggcatcagtatgtacgggcttcgtccttctgccgacattcaaaatgaaattccatttcaattaaagccggcttttacgctgcactctgttttatcccatgtgaaaaagatccgcaaaggggaaagcgtcagctacggcgcaacatatacggcagagaaggatcaatggatcgggaccgttcccatcggctatgcagacggctggctccgcaagctgagcggtacggccgtgctgatcgacggcaaacggatgaatattgctggaagaatctgcatggaccaattgatggtagaactggaccaatcttatccgccgggcaccaaagtcaccctgatcggcagccagaaggaagaaacgatcacgatggacgaaatcgccgggcggcttgagacgattaattacgagatcccttgtacgattagttcccgcgttccccgtatgtttttggaaaatgagagtataatggaagtaagaaatcctttactgcaagaaaatacaagtaagtaaccgtcatccggaaaaagagaatttataaaacagctttgcttgacgtttgaataatggtatcattatgtctggatggataattggtcgtatccgtaagtttggtggaggtgtatgttttttgtctgaatccagcgcaagaaccgaaatgaaaatcagcttgcctgaaaacttagtagctgaattggatggtgtagcgatgcgggagaaacgaagcagaaacgaactgatatcacaggcagtgagagcgtatgtcagcgaacggacaactcgccataaccgtgatttgatgagacgcgggtatatggaaatggcgaaaatcaacttgaatatttcttctgaggctcactatgctgagtgcgaagcagaaacgacggttgagcgcttagtcagcggaggataatcattttgattgtaaagcgcggcgatgtttattttgctgatttatctcctgttgttggctcagagcaaggcggcgtacgcccggttttagtgatccaaaatgatatcggaaatcgctttagcccaactgctattgttgcagccataacagcccaaatacagaaagcgaaattaccaacccacgtcgaaattgatgcaaaacgctacggttttgaaagagattccgttattttgctggagcaaattcggacgattgacaagcaaagattaacggataaaataactcatctggatgatgaaatgatggataaggttgatgaagccctgcaaatcagtttggcactcattgatttttagtcatatttttctagttgctcatatagagcaactttttttgttttcgaaaaacattagcgctataataaagagataatcaaacaaaatatgttgttttgtgtcgggaggtcagcgaaacccatgtcgaatcagaaagtgtatcagttcattattgatcagcatgatgaactgcttgatacttggacagccaaattaaaagaagtaggcaatcaggaagattatcagcttacgtatcacatatccgaaaatatctgcaaagactatatagacattcttttattatcgacaaaagatgacgaggctgcggaagagcagatcagccagctcgcactgcgcgccgttcagctcggcctgtcattgaagcttctttcagtcaccctgtcagagttttggaagctgctttacgaaacgatggttgaccatgagatggccgatcatgacagagcagaactgatcttggaaatagacagctttttcagcccgatcaacacggaaattttaaatcagtattccatctcttgggaaaaaacagtttctctgcaaaaaatcgcgctgcaggaactgtcggctccgctgatcccggtatttgagcatgtaaccgtcatgccgcttgtcgggacgattgatacggagcgtgcgaaacaaatcatggaaaatctgttaaacggcgtcgtaaagcaccgttcacaagttgtcttaattgacattacgggcgtgccggtcgttgatacgatggtggcgcaccacattatccaagcatcagaagcggtgcggcttgtcggcgcgaaatgcctgctcgtcggaatccgtccggaaatcgcgcagacgatcgttaacctgggaattgatttgtcgcaggttattacgaagaatacccttcaaaaaggaattcaaacagcgcttgaaatgacaaatcgaaaaatcgtttcattgggggaataacattgtgagacatccaaaaatcccgattctgaaactgtataactgcttattggtatccatccaatgggagcttgacgaccagactgctctgcattttcaagaagacctgctgaacaaaatctatgaaactggcgcaaacggggtcgtcattgacctgacatccgtcgacatgatcgattcatttattgcgaaagtgcttggcgatgtcattaccatgtcaaaattgatgggcgcaaaggtcgtattgacaggaattcagccagctgtagcggtcacattgattgaacttggaatctcacttgaggaaatcgaaacggcgctcgacttagagcaggggcttgagacattgaagcgggaattgggggaatagcgatgaacgaccaatcctgtgtgaaaatcatgacagaatgggatatcgtagccgccagacagcttggccgcaacgttgcgaaggaattaggcttcggcacggtggatcaggccagaatcacgacggctatctcagaattggccagaaatatctacttatatgccggcaaaggccaggtcagcatagaacaagtaaacgacagaggaaaaaaaggccttaaaatcatagcagaagacaaaggacccggaatcgcggacatccgtaaagtgatggaagacggcttttcaacgtcaggcggattgggagcgggccttccgggcgtgaaaaggctgatggacgaattcagcctgcaatctgttgcggaggaaggaacagagattcaagccgtgaaatggcttcggtaggaggttagaacgtggatttcagggaggttatagagcagcggtaccatcagctgcttagccgttatatagccgaattaacagaaacatctttatatcaagcacaaaaattcagccgaaaaacgattgaacatcaagttcccccggaggaaattatcagcatccaccggaaagtagtaaaagaactttatccggatctgccggaagatgtttttcattcgctggattttttaatagaagtcatgattggttacgggatggcttatcaggagcaccaaagtctgagagatatccagcaggagattcgttcagaaattgaaattgccgcaaatgttcagcagacgctgctcggcacaaaaattcctgaggaagaagagctggatatcggggcgatcagcgttcccgccaaacagatgagcggggactattatcactttgtcaaagacaaggaatcgattaacatcgcgatagccgatgtcattggaaaaggaatacccgccgcattgtgcatgtcgatgattaagtatgccatggactctcttccggagatcggcattcacccctcccaagtgctgaaaaatcttaaccgcgttgtagaacagaacgtggattcaagcatgtttatcaccatgttttacgcaaactacaatatgaaaagccaccaatttacctatgcttctgcggggcatgaaccgggcttctactactctgaaaaagaaaaaaagtttaatgacctggaggcaaaaggattggtgctcggaatttctcaggattttgattacagccaatatgaacagcacctggacgaaggagacatgatcgttcttttttctgacggcgtcaccgaatgccgtaccgaaaacggtttcctggagcgcggcgacattcagcgcatgctggaagaacatatggactgctccgcgcaggatatggtcaaaaatatttacgacagcctgctgagactccaggattttcagcttcatgacgattttacgttaattgttctgaaaagaaaggtttagaaaaacggcagcacgggtaaaaagccattagcacgagtaaggataactttcagaggtgatacgatgaatttaacagtagatatgaaggaaaatctttcagatatacaaatcaatatcgccggagaaattgatgtatactcagctccggtggttcgtgaaaagctgatgcccctggctaacgaggggaaaaacatgagaatctgcttaaaagatgtgaactatatggacagtacgggtttaggcatttttgtaggcgtgtttaaaacggtgagcaaggaaggcggttctttgaagcttgagaatctttccgaaaggctcgtccgtctgtttgaaattacggggcttaaggacatcatcgatatttcggcaaagtcagaaggtggcgtgcaatgagtacatcagttgattatatagagatgaaaattccggccgaaccggaatatgtaggaatcgtcaggcttacgttatcaggtgtggccagcagaatgggctatacctatgatgacattgaagatttgaaaatcgctgtcagtgaagcttgtacaaacgctgtccagcatgcatacaaagatgagaataagggagaagtatccgtgcggttcggtgtgtttgaggatcggctggaggtcattgtcgccgatcagggagacagctttgattttgatcaaaagcagcaggatctcgggccgtacacaccttcgcacacagtcgatcaattgtcagaaggagggctcggtctatatttaatggaaacgctcatggatgaagtcaaagttcaaagcaactctggcgtaaccgttgcgatgacaaagtatttaaatggggagcgagttgatcatggcacaaccatcaaaaactacgaaactaactaaagatgaagttgatcggctcatactcgactttcaaatacatgataataaagaagcccaggaaacacttgtcgaggtgtataccaatctcgtcgaaatgctggcaaagaaatattcaaaaggaaaaagctttcacgaagatctccgccaggtcgggatgatcgggcttctcggtgccattaaacggtatgatcccgaggtcggcaaatcctttgaagcatttgcaatcccgaccatcattggtgagatcaaacgcttcctcagagataaaacatggagcgtacatgttccgagacggattaaagaactcggcccccgcataaaaatggcggtggatcagctgacgacagagacacagcggtcgccgaaagtcgaagaaatcgcggcctttctcgatgtatcagaagaggaagtgctggaaacgatggagatgggaaaaagctatcaggcgctgtctgtcgatcacagcatcgaagcggatgcggacggaagcaccgtcacgattcttgatatcgtcggttcgcaggaggaaggatacgaacgcgtcaaccagcagatgatgatcaaaagcgtgcttcatgtgctgtccgaccgcgaaaaacaaattatcgatctaacttttgtgcaaaataaaagccaaaaagaaacaggggacattctcggaatatctcaaatgcacgtctcgcgcctgcagcggaaagcggtgaaaaaactgagagaggccttgattggagatccctccatggagctaatgtaatgattcaggttgaagaaaatgaacatgtgcaaactcttgtataccaattaaataaagaaggcaagtccatatgcggcgacagcttttttataaaggcgaatgaagaggaattagtctgcgcggtagcggacggtctcggcagcggatctcttgccaacgaatcttcgtcagccattaaagacatcgtaaagacgtatgcagatgaggatgtggaaagcatcattgagcgctgcaatcaagcgatgagaaacaaaagaggggcgactgcctccatcttaaaattcaatttcaccaaaagggaactgacatactgttcgatcgggaacgtccgtttctttctgcattccccatcaggcgaagtctttcatccgctgccgatttcgggctacctttcaggcaaaccgcagaagtacaaaacgtatacctcatcatatgaaaaaggggcaacattcatcatctatacagatgggctggaggttccgcatatccgcacctgcttaaagcagggacactcaatagaagatatatcaaaatcacttcatccgtacacaacatccagacgtgatgatttgacctatattctcgggcagcttttatcgtaaggctgctttttttatgttccgccgttttttgatacactagagaaagaatgaagagatggaggcttttgtgatatggaaacgttagcccttttgaaaaaacaaattgctgaagaaacagctttatcccaaaaaaatgtcgaaagtgtcatccgcctgcttgaagacggcaataccgttccgtttattgcgcggtaccgaaaagaacagacaggctcaatggacgaggtgcagattcaggcaatctccgagcggtggcaatacatacaaaacctgacgcagcggaaagaagaagtcatcagattgatcgccgaacaggacaagctgacggacggactgaaacaaaaaatcgaacaagcggccaaacttcaggaagtcgaggatttataccgtcccttcaaacaaaaacggaaaacaaaagcgaccgtcgccaaaagcaaagggcttgagccgcttgcggactatattctttctctcccgaaagaaaaccggctccatgaaatcgctgatcaatatatcagtgaagagaaagaagtcgctacaagagaagaagccattgaaggcgcgaagcacatcatagccgaacaaatctcggatgatcctcattttagaaagtggatccgccaggaaacgtataaaaaaggaattctcacatccacggcaggcaagtcagccgcagatgacgagaaaaacgtctatgaaatgtattatgaatacgaagagccgatccaaaaagtcgttcctcacagagtgcttgcgatgaaccgcggtgaaaaagaaggcattttaaagattgcgatcgaaccgcccgccgatcagttgaaagcttatttagaaaagcaaatcatcaaacatcgtgaaacgcctgtgaaagaaacgctgaaagaagccattgaggacgggtacaaacgcctgatccagccggctattgagcgtgacatccgcaaagagctgtcagaaaaagcagacgcgcaggcgatccatattttcgctgaaaacctgcgtaagctcctgctgcagccgccgatgaaggggaaagtcgtgctcggcgtcgatccggctttccgtacgggatgcaaactggcagtcgttgacgagacgggaaaagtgctgaaaatcgacgttatttatccgcacgctcccgtcaaaaagacagccgaagcccagaaaaaaatcaaacaattgctgaaccgttacgaagtcgaggtcgtggcgatcggaaacggcacggcatcaagagagacagagcaattcatcgttgatgtgttaaaagaaacagagcgggacatctattatgttatcgtcaatgaggcaggggcaagcgtgtactctgcgtcagaaatcgcccgtgaggaatttccggattttcaggtcgaagagcggagcgccgtctccatcgcgcggagattgcaggacccgctggccgaacttgtgaaaattgatcctaaatccgtcggcgtcgggcaataccagcatgatgtcagccaaaagcacttaaacgaatctctccgttttgtcgtagagaccgtcgtcaaccaagtcggggtaaatgtcaatacagcatcagcagcgctgcttcaatatgtagccgggttatccaaaaccgttgccggcaacatcgtcaaaaaaagggaagaactcggcaaattcacaaatcgcaaagagctgaaagaaatcccgcgcctcggtgcaaaaacatatgaacaatgcatcggctttttgagagtgcccgaaggacaggaaccgctcgaccgcaccgggatacacccggaaagctataaagagacaaaggcgctgctcaaaaaacttcatctcacagcagatcagatcggaagcgcagacgtaaaagagaaaatcagcgcacttccgctgtctgaaacggcagaagagctaggaataggggacattacgcttgcggatatttgcgggcagctgacaaggccggagcgcgatcctcgtgacgaagtgccgaaacctttgctgaaaaaagacgttctgcagcttgaggatttaaaggaaggaatggaattgcagggcaccgtccgcaacgtcgtagacttcggcgctttcgtcgatatcggcgtcaagcaagacgggcttgtgcacatctcaaaactgagcaatcaattcgtcaaacatcctcttgacgtcgtatcggtcggagacatcgtcaccgtatgggtcgaaggggtggacgtgcaaaaaggcagagtgtcgctgtctatggtaaaataaaagcactgcttacgagcagtgtttttttctgtagaagtaccagcactggttcagcagtttgatttggtaattgtccttttctaaaaacgctttttgcatttgtttcatcagccaattcggcatggctcattcctcctcagcttttagttagagggcggttttaacacattgtatgcgaacggtgaattgtcccgttcaatgtttttaaagcggggtgcacttatggataacgaacaacttcaaaagctgacggaagacatctctgcacaagatttcggaaagccgttccgccaccgggcctttttcaatgaccggctgaaaacgacaggaggccggtacatgctgtcttcccataacatcgaattaaaccgcaaatatctgctcgaacacggccagagtgagctcgaaggcatcattaaacacgagctgtgccattatcaccttcatcttgaaggaaaagggtacaagcacagagacaaagacttcagagagctgcttcagaaagtcggcgcgccgagattctgcacgccgctgcaaacaaaaaagacagaaaagaaaacatatatgtatagatgcacggcttgcggccaacagtatataaagaaacgggcaatgaatccggaaagatatgcctgcggaaagtgcagaggaaaaatcaaaagaattttttaaaaaggcttgactcatttcggtgatctatgttaaattataaaagtcgttgagagacagcgatactttctcaaaaaaataaatgttgcttcttgacacaatatgtcgcatcatttataatgaagaaagtctgatcattccacagtagctcagtggtagagctatcggctgttaaccgatcggtcgcaggttcgaatcctgcctgtggagccattatggagaagtactcaagtggctgaagaggcgcccctgctaagggtgtaggtcgcgtaagcggcgcgagggttcaaatccctccttctccgccagataagttctcaaccagacggcccgttggtcaagcggttaagacaccgccctttcacggcggtaacacgggttcgaatcccgtacgggtcaccatttaccttcgttgggctatagccaagcggtaaggcaacggactttgactccgtcatgcgttggttcgaatccagctagcccagccattttattttaaaatttttaatcacttttagagcgagccattagctcagttggtagagcatctgacttttaatcagagggtcgaaggttcgagtccttcatggctcaccacttgtcacgcgggtgtggcggaattggcagacgcgctagacttaggatctagtgtcttacgacgtgggggttcgagtcccttcacccgcactttattttcaaagtgctgatcatgattcactagcttacatgcttagtggaaagacagcttcatagcacgcggtcgtggcggaatggcagacgcgctaggttgagggcctagtgggtgaataacccgtggaggttcaagtcctctcggccgcatcaatgataccaaggattatagagatccttggtatttttttgtgcttatttttaaatgatctgctgcccgtaaactggcacttacctaaagtaagttccgttattcccacgtgaatatatttgcgataaggtattgaatcaatatacgatccactcaattatttgagtggatctgtttgttttttatttatttgcagcagtctctatgtgacgaaacaatagattcattaaaaccctttacgcagccaggttgtggcaagatcaattgctccgcgcgcggcttcagttttagctaaggcgttgagcatcacgaagtcgtgaatgataccttggaaacgtacggcagtgaccggaacaccagcttcacgaagtttattggcatatgcttctccctcgtcacgaagtacatcagcttcagctgtgataatcaatgcaggtggaagcccttgaagttgctcagtagttgcacgcagaggtgatgctgtaatctcagcacgctcgttcgaattggttgtgtactgatcccaaaaccacatcatcgcgtccttgcgtaaaaagtatcctgtagcaaactggtgataggattccgtatcgaaagaagcgtctgttaccggatagaaaagtaattgttgtcggatattcaagtcacctcgtgctttggccattagcgtgacagcagcagtcatattgcctccaacactatcacctgcaattgttagactctctggattcatgccgttctcacggccattttcagctgcccacttcactactgcatagatttcttcaatggctgtgggatattttgcttctggagataaggtgtaatttggaaagacaatagcagcttgtgctccaactgctagttcacggatgagccgatcatgtgtatgctcattaccaaatacccagccggccccatgaatgtacacaatgacaggaaggtgcgcaggcgcattctgtgggcgcattattcttactgacacctgtccgctcggtcctcctgaaatcataatatcttcaatatcaactggcagtttatcaattgggtcagattgaacctcatctacagcttctcgtcctttctcaggtccaaggtcgaatagataaggtgggttcgcggttgcttctgcaaattcttgagctgctttttctaattgtacttttttcaacatagatctctctccttatttgaaggttggtcacctatatgttttaatcaaatttttttattctattacctattgatcttggcatctttcgtcttacattgctgttgtaatgatttgtacatcaatatttccgcgagtagctttagaatatggacatacctgatgagctgcatgtgttaattcttctgcttgctcttgagataccccttgaatttccacctccaaaacaactccgattttataaccattatcactttcatcttttaataaacttactttaccagtaacagctgattcgatttttaatcgttgtctttgggctgctaaatgaagagcactgtcataacaagctgaatagcctgccgcaaataattgttctggatttgtagcagtggatacttgatttggttttggcatagctaaatccaaatcaataataagatcattagattttacatgaccttctcttccaccttttgttgtagcttctgctgtaaaatatactgtcatcatcaaacactcctataaattaaatttaacacaattgaattttaaacaattaaattaaggttgtcaattaaatttttaaaaattgaattgttcacaatataaattcgcgattaaaatccttgataggagatcatattattggtgatagattttttgtgattttgtataaattatgattaattaaattgttagtaattcaattttacttaatgtaattcttgtgctattatgtgtaataatgaatataaatattgtgagggatataacatgaagaatgataaattactgttaagtaatcatctatgttttgcgatttacgcagcttcccgtgaaatgataaagttataccatcctctcttaaaagaattaggaattacttatccacagtatttggttcttcttgttttatgggagaaggaaaaaatatctgttaaaggtttaggcgaagaattatatctggactccggaacattaactccagttttaaaacgacttgaggagcgaggtcttattataagagagcgttcaaaagaggatgagcgaagtgtaattattacgttaacaactgaagggaacgagtttaaagaaaaagtcacattgattcctaatgcagtatttgataaaaccggttgtaatgaagaagaaattaaaagttataacaaggaaattcgtaatttacttaacatgctgacaactgagcaatagttttatgaatatagatggttttgctattatgaagtctaaagtgcttagtttaagggccctgcgggtgaataacccgtggaggttcaagtcctctcggccgcatcaatgataccaagggttttgacgcccttggtatttttttgtttatagaaatttatctgttactgcccacttacttataggcgtaagctctcacgtttcctggatgtcaaataacaataatgatatgcaaggttggtattatgtcacggtggatggtcaagtgcaaacataaaaagcccaaagatgggctttttttatttcattgattgtgctaactgaaccatttcagtatcctttaagttagagctatccatttctacataggttccgttttgtacccatcttaaaatgccgccttttgttccatcagcccatctttcaaatatacctttctgtccattaatagtaacgtttttaacgttttttccatctgaataacgtaacggttgatttttaaatttgctttgtgcaatttcgaccatcacatagtttctgtaagcatggtcttcataattaagtcttgtcatgcttatttttttgtcttgatttagataattttttatggttaatttccaatttgaagaagtgtctttaggtactaaaacatgaaaatctgcatgttcttttaaataagataaatcttttcttgaaaaattttctacagcgaagtctgaagttgcagtaactttgagatttgaccaaggatttaaaagaaaaacaagtgaaagtgatattccaatcagagaatatttcattttaattgctccttttctgttaataagcaacttaaggacagtatccctattttgatatgtgaaatacgtaaaatttaaatttttttttgcataatttggattagtgaaggtatcaataaaaaaatatcttttgcctttagcgatcaacaaataaagaatgaatagacatagtatctactcatttttttgtatgtgcaggaatgtgctttggtttgaaaccaatataacttaaaccttaattttagatataaagttcctttttacattttaactttatcaaaaaatgttcgatctgccataatacaattaatttaaatattgttacaattttgtattgtgcagcagctttgcttagggattcagatgaaaagtcgtagtgtatgcagataatatttgaaaggagtttcgaataaaagatggatcgaataagtgcatagagctgcccaatttctgcccagaattaatgttaaatgataaaattcagtgtgaattaaataaactgatgctttaaataaaggcttttgtaaacgatgatatgtttttacttaggttgagggcctagtgggtgaataacccgtggaggttcaggccctctcggccgcatctcaatgataccaagggttttgaacctttggtatttttttgtgttttatgattgtgagcaaatgtgtctactaacttgaagtgaagtgcttctatattgtaagtctgtaatcggtatctccattcatcctttttgctgaatgcgtgcggtgtaaatggggttcataacgtaataaagaagtataagacctcttttagtgaaagaggaaggaatactattgatgccaaaagagataaaaccttgaaatttgttggtgatattttagaataaaacttactcttgacttttttattgctgatttcattttgtaaaccgtcgtactgctacacacccgattgctcctaatattcattgttatgttgcttcaaaataagacttgataacgttgtaaccaagtggtacaaagagcacctattattttaataggattgctcttgttttttaaagcgtatattttcaaagccatgtcattgcagaaaagttaaaagaaataaaaaattaatagttgacttaagcaactgtatcaattacgatagaaaaaagttgcttaagtcaatcttttggaggaggtacgtaaatttggcaacaaaacgtgttttggcattcagacaatttaatagattttatacagatattttgggttttctaaatgaacatatttatgacagtccattctctttaacagaaacaaggattttatacgaaatttataatacacccgattgtacagcaaaaatcattcaagaaaggttagacctggacagaggatatgtaagtagaattgtcagaaaattagaagaagaaggcttcatatataagcaaaaatgcagagaagacggacgaaatcatttcctttatgtaaccgcatcaggggaaagtatttataaaagtctggagaaaaaagccaatcagcaagttgaatatatccttgaatgcatagacaaagaagaacaagaaaaacttgtagattctatggaaaccattcaaaacattttgcagcattctttttatgataaagaatctccgatttcaataagagactattatacttcagaagatgtcaaaaacataattgagaaacagcgattattttatgccgaatcccatggctgggatgaaacatttttatcctatcttcgcgatacgtttaaagctgatattgaaaaaatatgggtggcagaaagcgggaatcaatttgcgggttgtatcggcttagtgaatgacgatgaaaaaacaggacagttaagatggtttttagtcgatccgtcttttcagagaaaaggtgtcggcagccgtctgattaaggcacttgttcaatattgtaaagaaaatggatacgagcgtatatttctttggacggtaaaagacatgtcaacagcacggccattgtataaaaaaaacggattcgaaattacagaaattcatgaagaaaaacctttatggggatcaaatttaatagaagagcgatgggatttggaattataaagtgagggggggataggatgccaataaaatatcattatgcatggatcattgtttttgtcacttttttaacctttttagcggttcaaggcgcacgtctttcatttggagcttttgttgaaccatgggaaaaagatttttctatgaatagaggaacaatttcacttatttccactctgagttttatcatatatggcatatctcagcccataatagggaggctggttgataaattaggaccccgaatgattttatcaatcagcacatttttggtcgggcttagctttattttaacgtcttttgtgaatcatccatggcagttatttattctttatggaattgttatctccgtcggtgttggaggggcatctaatgtagccgcgacagttgttgttacaaattggtttaatgaaaaacgcggactcgctttcggaattatggaggcagggtttggtgccggtcagatgcttcttgttcccggctctctcattttgattcaatggtttgattggaagttaactgtagtgattttgggtctgcttttaatggttattgtgtttcctgtcatactgttatttttacggaatcatcccggcgagatggggttatctcctatgggcggttttatcaaagcagaagctgaaagtgaccagcatacggcccacttttctgtttgggcagtgttttgcaagaaacaattctggtttttaatactaccttttgctatatgcggttttacaactacaggcctgatggatactcaccttattcctttttctcatgaccatggattttcaacaagtgtaaccagtgctgcggttagtgtgttggcgggatttaatattttggggataatcatttcaggaattgcggcagaccgttggagcagtaaaaagatgcttattcttttatatgtcatccgcgcattatcaatttgcatcctgttatacagtcatcattcgattatattacttatttttgcaactttgtttggactggttgattttgcaactgtagctcctacccaaatgttagccacgcaatattttaagcaatattcagttggttttattttaggctggttattcctgagccatcagataggatcagcgctgggagcttatgtaccaggttttctttatagtgaaataggtaactatgatctttctttttatttctcaattattattttgttgggagcggcaatgtttactttcttactgcctgaaactgtgaaaataaaaaaagaggaaaagccggagactgattcagtttcatattaaacagctataaaattttcaagctcatcatacgaatgttaattataggggaagaacagattcaacagttgatctttttattaaatttaacagtgcccattttgtgctctcggccgcatctcaatgataccaagggttttgacgcccttggtattttttgtgtttctttttatatgatctactgctcacttacctaaagtaagtaaaaaatgatttacctctttatatcgtaaataaccaaactagaataaataggtaaaaaagcttaacttagtcatattagaaaacaggaagattgcctgatgaaagaagaaggctttcggtttaatataaaaacgcccaaaaaatggcgtttttaatgggtaaaagtatatatctcgaaaggaagatatttaaaactgagggaatatgcttaaaacaactaataaattagaagaggagagagatttaaaaatgtatatgacttgattctgtgcttttttaatttcttaaaagaattaaggactagaatacaaaaattaaagaagacggagaatatgaatgtttaaaaaaactggtatttttatattactttcttttataatcatttcagctttttcacagacggcatctgcacatacagttaaccccgtaaatcctaatgctcagatgacaacaaaggagttgacgaattggctagctcatctgccaaaccgaactgagaatcgcatactgtcaggtgcattcggcggatatacaaatgcgacgttttctatgacagaagctaatcgaatcaaaaatgctattggccagtcacctgcagtatatgcttgtgattattcgagagggtggttggagtcaggaaatattactgatgcaattgattatagctgcaacagtgatttaatttcttattggaagagcggaggtatacctcagatcagtatgcatcttcctaacccagcgtttcaatctgggcattataaaactcaaatctcaaacagtcaatatcaaaaaatcttagattcatcaactactgagggcaagcgattggatgctattttgagcaaaattgcagatggtcttcaacagctaaaaaatgaaggtgttcctgttctattcagacctcttcatgaaatgaatggagaatggttttggtggggactaaccgaatataacaaaaaagacagccagcgcatctcactttacaaacaactttatcaaaaaatctatcattatatgactgatacaagaggtttggacaacctgatttgggtatatgcaccagacgctaacagggactttaagactgacttttaccctggctcttcatatgttgacattgttggattagacgcttatttctcagacccttattcaattaaaggttatgatgagttaacagctcttaataagccatttgctttcacagaagtcggtccgtcgacaacaaatggcatcgtggacagcctggattattcacagtttatcaatgcaattaaacaaaaatatcctaaaaccatttatttcttagcttgggatgatgagtggagtcctgtggctaataagggtgcgtctagcctttataatgatagttggacactcaataagggagaagtgtggcaaggaagttcacttacaccaatcgttgaataaatagaactaaaagcaccatgaagatacaactgtttcttcatggtgcttttttgacaaaaggacgaatgtatttcacgctttagaaaatctgatttcaatggctcattcgatttatcggatggtgtaacaggtgggacgacgatttattttggtcaaaaaaatcagaagcgtatctctgcttttacgagaagaattatgagcaagcggaaaaatacaatataccgttagaagaattggagattagaatcgctttgacattggtcgccatgcagatcattaataattatgtaaggttcgttgatgccgacgaggaagtcactcgggagcattggaaaacgagccttttttggtctgaatttataggcgatgtagggaaactgcaactgtacatgaaaccgcaaagagacttttaccaaaaaacaaggaactggccggaaaactcatgttctcctaccatgatcatggaagctgaactgtcagagaaacaggaaaagatgctggatgtgttttttgctgaagtggcggacatggtgtttagaggcttatgcctttcgaatgaattttatcgtatgagtattgatcgagacgaaaaataaagagaggagagatcattaatgaagatcagccgaattctattgggagtaatggtgttaagtagcattttagcattttctcactttgcgggtgagcaggtttcaatcgagggatttaaaatagcagccgaccgagttggagcataaaaaaaagcgggggatgcccttcgttttttattttgctaatcttggtgagggatatgatgaaattatggaaaggtaatgagtgattacctttccgtaattcgttaattatttctttgagcaatactataattcattttaaccttaccaccgtcagccggtggtgaagctgtaaatgtgtaattgtatgtccaaccaaaccaaccatttttaacctcagcagaaatgtggccttgcttgcctggtgcgatggttcttgagacttttccatcaattgatatttttatgtcattactcccggtattttcaatccagaagtttacttgtgctccgtcattctcatctaattcgaagctccgactccagcttgattgatcaacagggccctttgaaacctccttgtctagagctttgaatacttcacttgcaactgcaaaatttttcgacgatacacttgtagtcgactccgcaaaagcaggtatagcacaagtcccaacaattacaccagctatcagagtcgatgatacacctttaaaaatggacttaaggttcacgatcaagcactcctttttaatttaatttattttattatacatgcatactccgcatatataatacaaataataccatgtaaaataattacagtaaatattttttttggataatgatgtttgcaactcaacttttgtatcccaaacatccgaaatcagacaagtaagccttgatatagctaggtaagtggaaattgcgatcttcttattgaggtactgctactagcaaagtttttccgatacccgcaaaacgaaaaaacacctgtcctttctctaaagtaacgaaaagggtagtgttttttgtgctattcaaaattaatacgtactcttttttactctgtctatctatactgaattacaaaatcggacaagtgaagatactatcaaaagaaaaaactcagtgggcgataccacattacttctcttgttagtggtttcttaggttttagctggaattacaaatttaaagctaatattttagtgattttttaaaaaaagtactgcccaattattgcccaaaattcatgaaaaaagaagaaaataggtaggaatgaagataaagaatgctttatttataaggtttatgtaatacatgatgcgtttccacaaggttgagggcctagtgggtgaataaaccgtggaggttcaagtcctctcggccgcatctcaatgatgccaagggttttaaacatttggtatttttttgtgtttatgattgtgaccaaatgtgtccattaacttgaagtgaagcgtttctgtactgtaagtctgtaatctaatgggtacttcccggtatctccattcatccttctgctgaatgcatgaggtgattcataacgtaataaagaagtataagacctctttaagtgaaagaggaagggacctgttgatgccaaaagagataaaaccttaattcgtgtatatgatggtgggaaatatattcagtttgctttttataatgatgcttcactcaattattcctcgaaaaaaagtttctaaatatagttggactgatatattatgatagcctacatatgtgataacaatagcagatttagtaggtgtaacagaacgtaaaagttagtatttgagtagggggaaattatgctatcacttaatagagctttaaaattacgtgatttagaaatttttcgtgtgctgaaagatggtaacattttatcttacgtaataattgaagatactcgaaagccatttacagaagaagacaaaaaattagaaccattatgttatatggacgaagaagatattaatgcgattttaaatgtttttaagatttcaattgttaatgatgaaaaattaaatgaagctgattcaacttttataagattctacttttccgaatttgttaataatacaaatttaacgaattttattactaaagaatatgtacaaaaggatttatatgattacgaggatgaagatgacatcattttctttaatagaattttacgtagtataggatcagattatgttattaaagaatttgacgatataaattggattcatttatctcaagattgatttctgatttggcccgatgactgcttcagcttgctaggctaggtgcctgatatgatcctcatgctattctattaactcttagtcaggatttaatcgatcaagctataccaataggtacagcattaattttacaaattcaatcatcgaaaaacgaaaaaacaaaatatgacttgtaaattaaaggctgtcttaaaggcacaaaaaaagctcaaactaatgaatttagtcagagcttttttttatgaagtattcccgagtatctgtccttgtttttttaggcaatactacgtccaattctttatttaaccatgcgagcgttttattacgaagatacttacgcatctgttcttctgcttcaagcattaccaagttaattgtacaagaagaattgctggattcacaggagttgcatttgtctcgataaagcaggccattgcttacaatatttttacattgaaaaatgggttttggtccttcaacagcctctattacatcccaaaatgaaatatcttccggggattttgctaacctatatcctccctttacacctgggacagaatttacaataccagctttagataatttaccgaaaacttttgaaagaaatgtttctgaaagtccttggaactctgcaaggtcccgaatcccgacacttttcttggagggaacatctattaaataaaccaggcaatgtaaagcatattcaaccccagcactatactgcatagaaactcacctgcttttgtttttgtaggtaatcacattgtatcttaggagtattttgggtgatagtcaatcataaaacccttctttagatatattatttgtttcatttgacaaaataaaatgaagggtttatattaaagaccaatttaatcgtcgattgaattggtctttaatagaagataaaagggggaatttcaaatgagcaaaacacttatcattaacgcacatccgaaagtagatgatgcatcatcatacagtttgcaggtaatgaaccgctttttggaaacttacaaagaattaattccaaagagtgaagagcttgagcagattaacttgtatagtgatgaagtgcctatgattgataaaacagttttaagcgcatgggaaaaggcaggaaaaggtgatgaactgactggcgatgaacaaaaagtaacggaacgtatgactgaagtattgaaacaatttaaaagtgcaaaaacgtatgtcatcgttttgccattgcataatttcaatattccatcaaaattaaaagactacatggacaatatcatgatcgcacgtgaaacatttaaatatactgacactgggtcagtgggtctgcttaatgatggacgaagaatgctcgtcatacaagcaagcggatcaatttatacaaatgatgattggtatgaagaagttgaatactctaataaatatttgaaatcaatgttcaatttcctcggtattaaggattatcaaattatacgagtgcaaggaacagctttactaagtccggaggatgttttacaaaaagcaaagaaagaagttgaagaagctgcttcaagattagcagggaaaagggaaacctgaataacattgttggttagaacagctgaagtgacagagagattcgtctattatacggtagctaaaagagatttctcactgcttgttatcccttttgatttaacgctattggaacctctaaaaaaccataccaaaacaccccgcaatgaaacgtaatattaatttgcagttatttccgtttcgtgctatgataaaggggaattatttttgttcgtgtaaaggatagtatgaatatcgacttttcgtcttgatgatactttgggcaaggatagtaatacaatgtgtggtatcacactaggaggcaacaaaaatggaacaaggtacagttaaatggtttaatgcagaaaaaggttttggatttatcgaacgtgaaaatggagacgatgtattcgtacacttttctgcaatccaaagtgacggattcaaatctttagacgaaggtcaaaaagtaacgtttgacgttgagcaaggtgctcgtggagctcaagctgctaacgttcaaaaagcttaatcttcaatcgtttatacaaacaggctctttatatagggcctgtttttttatattctctgtataatacttaataaaaaaccctactcaacgttcgagtagggggagatggtacaaggtaatagaaaaaggtttaaaacttcaaaggtttgtatacagtataacatactggattgacaatatgcggaatgtatataaattatttgtttttctgttctcaatataactgcatgttattctttcttctttcactaaaattgctcgttaatttaagcacaaggattaggctgacgaaaactttcgtcagcctttttatattaaggaagaaattaaaattctcaaagttagagcgtgttttgttttgactcaccatttttttcaccataattcatacaaacatatagaaatgacgtaaagtgaagtgggtgaataacccatcactttttgtttctttataaaaggggagggaatactccaagataataaagagaaaacaaaaaagagcccgcaggccctcagaaaacatgagtaaaataattcacttaataaaatctgcgtcctcttccaacgaatccaaaccgtcttcttctttcgaatgcaagaggtgaaaatccccttctaaaaccgccacgaaaaaatcggtttcttgcatataatccaaataaaggcatgggttttcctcctttcaggtcataagttatgagacgcggatctgctccgcaggcgttcaacaatctacaatgattagcagaacaaatatgaaatgactaaggctttgcgaaaattaaatagatcttgtttacaatctattcatcataacctcttcagagtcacctcctgtttggagtaattaatcatcgaatattttatgtgtagataaacaaaatagattgggcgaactttagttattataaaattccacgttatagcaatctggctgaacgtggcaccacacatatgaagaacccttttaattttccatggtgtatccgccatccttctgctgactgcgtgtggcggaagaagtatgacaattcgattgatgaagtgataaagcagtagaagaaagccagaaaagaaataagggcagattcagatgaggataagaaggataacgctgaatttgggtagaataactcttggtgacagattggtacacatttttaaggggggacaactatgattggaatactggcaggaatgggaccaaaatctaccgggccatttgtagataaagtagtagacgagtgccaaaaaatatatggagcaataaatgacattgattttcctcatatgatgatttattcttgtccgactcctttctatattaataaacctctcaatcatacggacatggaaaaggcaattattgagggtgctgtaaagcttgaaaaaacgggtgttgattttatcgccatcccatgtaataccgctcatatctattttaattcattaaaaaaattgatttcagtccctttactaaacatggttgatgaaaccataaaaaaaataccaaaaggctcaaaaaaagcagctcttttagccacctctccaacggttcaatctggaatatttcaagaagccttaatcagagaaaattatgattttttacatcaagatagttggcaaacctgtgtcgatcaaataatagaaaagattaaacaaggtcaaatcaatgagtctattacattatttgatgaattacatcgtgaattagcagaaaaggttgatacggctatcattgcatgtacagatttaaatgttgtcacggataaaaaaagcagcgatattacctttgtggattcatcagcttgtctcgctcaagccattgtcaataagtatgtatcattaacaaaataactctttgaatagttgagtggactttgtgtctgctctttttttatggggaattcatctaaacagtaagccgtctgatttatcagcaaattcagggcgctttttttccgttaaagcgcccgactgcggcagaaacattatccccaaattacttctttgaatttaacttcctcgcattatttttcttttaacattgaatactttcgataagctttatagtaactgatgccaaagataacagccataagggcgggaagcgatctcaaaagggcaaatggagtttcaaataaaaatgctttccaaaacattgcgctttccatactccacagaccttcagctaaatataaacctgaatccttgtaaatcatataagaaaaaaacaagcacagtaagccaaaacaagatgaataacccattaatcttttataataattactctttgattggcgatccgagaagatttcattttgatcatcatcttctttttgccaatatcgcgttccgctaagccatgggctgtttatataactccagccgaagtcttcatagatccctttgtaatctttgaactttttctttgataaataatcttgataatccagccgcatcacatatctcttatcggttttttcgaaggtgtatattcctaatccgctgatatttgtacagcgatagcctttttgtaattgctcgttcagccattgctcctctttttcaatatcaaaaaacatcttaaatttcttcattcgattcacttccttcgtacagggatagaatatgcaataacctattttgttccattttcaaaatgtcgcttccttctgcagttatcatatagacttttctccggcctgactctccaacaggttcaatccagccatgcttattcaagttttcaatcgcaccgtataatgtgccggccgctaatataacagttccgttactcatcttttctatcttctgcatggcggcataaccatgaagcggctcacgcagagctaataaaatataatgcatggtttcagacagcggtaataatttatgtttcatatcgtcaccctctattcagttcgactatatagttcaactttataataaaagtaatacagttcaactgaatagtcaatggttttttcaaaatttgtaaaaataaattgataataagaggacatcaatctaaaaagccgccttcctgcgtaagggaaagcggctgcacgatattatatgtcagccaaatcctcaggggtaattggctgctgtaatttcaaagtatgtgtttggcataatggattaaaagaaaattgttttctaaacggtgcgatcatataattgaatgaaaaaaggaagcatatcatgccgatcaattcttttgaaaactatccgatgagctggaagccgacgattgataaaacggaaaagcccatttataaagaaattgcggggaaattggaacaggatatattacaaggagttttattacccggaaccaagctgcctcctcagagagaattagctgattatttggatttaaatgtaagcactatttcaaaggcttttaaagtttgcgagttaaaaggtctgttgagtgcatctgtcgggagcggtacttttgttgcttacgatgcattatcgaatgcgtatctgctcgaagatacaaagccgaagcatctaattgaaatgggagcgacacttccggatcaggtttcttatgagccgctgctgctccagctgaaaagtatgctgcaagaggaagattacgaaaagtggtttggctatggccggacaggtgaaagtctttggcagaaagatgcggctgtcaagctgattcgaagaggcggatttgaaacgtccgttgatcacattttatttgcaaacggcgggcaaaatgcgattgccgccacattggcaagtctttgtaaaccgggagatcgcatcggagttgatcatcatacatatcccggcttgaaaacggccgcatcaatgctgagtgtgcagattgtgccgataaaatcagagaacaatgaaatgagcccatcctcatttgaatatgcgtgtaaaaatgaaaatattaaaggcatctacctaatcccggattatcataatccgacagcgtcttttatgtctgttgaaaatcgaaagatgattgcgggcattgcaaaaaaatataatcagttcattattgaagatgcatcgtaccatcttctggggaaaaatccgcttccggctatcgcatcatttgcaccggagcagacaattcacattgccggtctgtcaaaatcattagcaccagggttgaggctggcgtatgtcgcagtcccgagtcaatataaggagccgatttcaaaggcgctttacaatttaaatataactgtttctccgctattagcagaacttactgcacgcacgatcgtatcgaatcaatttgaagtcttaattgaaagtcatcgtgaacagaccattcgcagaaacaaaatcgtaaatcaatatttacatggctatacgtgtgcaggtgctgaaacgggaatctttcgctggttaatgttacccggaaacatgacaggtgcggaatttgaaaatttagccgcgcaacatggagtgcaagtgtatgcggctgaacgctttgtcgttgggaatagttgtccggaaagggctgtcagagtgtctgtctgtgcaccgaaaacgcttgaagagcttgagcagggcttaatgattcttaaacgcttgctggatgagcatatgtaatattgttcgccatacaattctcatattgtatggtttttttgtgcgtgttatgataatccaaatttgttggaggttataagaaaggcaggtcgggttatgcttcaaaaagacagtataaatgtatcagatggtcaatcggcatcattgcggcaattcatagattctcctgaaaaacaaaaagcgttatataagcgtactttagctgtcgtcagtctttcacaaattttcggaggtgcagggctggcggcaggagttaccgtcggtgcgcttattgcacaggaaatgcttggtacagatgcgtttgccggtgtaccttctgctttatttactttaggatcagcaggcgccgcattatttgtggggagactttctcagcgttatggccgtcgaacaggtctttcagccggttttatgattggcggactgggagcgataggagtcatcattgcggcaatgataaatagtgtttttctgctgtttgcttctttgattatttatggtgcgggaacagcgacaaatctgcaagcccgctatgcaggtacggatttggcaaatcacaaacagcgggcgactgctgtcagtatgactatggtttttaccacatttggtgcagttgcaggcccgaatttagtgaatgtaatggggcaattcgcgctctctatcggtgttccgtcacttgcgggtccattcattttagcggcagcagcatatattttagcaggtgccactcttttcatcatgctccgtccggatccgttagtcatagcaagaacaatagaaatttccggccaaaaacctggtgatagaggccaagtgaccgcggacgaacacacaaagaaaaaaagagggatcattgcgggtgcagcggttatgattcttactcaaattgtaatgactgctattatgacaatgacaccggttcatatgagacatcacggtcatggcttaggagcagtaggtcttgtcattggctttcatataggcgccatgtatctcccttcactggtgacaggtgtgcttgcggataagttaggccgtactgtaatggctgtatcttctggaatgacgctgcttttggcaggactcgtatcggcatttgcaccgggagattctatgattcttatggtcattgctctatctttgctcgggttaggatggaattttggtttaataagcggaactgcacttattgttgattcaactgaagcttccgctcgggctaaaactcaaggtacagtggatgttttgattgcgttgtccggagctgccggcggagcattgtccggaatggtcgtagcaggcgcaagttacctaacattatcacttggcggaggaattttatcattattattaattccggtggtgatatggtcacttggaaataaagaataggtttgcccaaaatgaacacaaaacggcgtaaatggatacaatgaataacttcaaatacttgaaataacaggctattaagggcctaggtgggtgaataacccgtgtgaggcgaggttcaagtcctctcggccgaatcgaaaaataccaagggtttttccgcccttggtattttgtccgttcttatttgctgttccagtttttctctataaatttattcacaggctgtaagttggttttgttcgcaatttcaatgacagcgggaaccacggaagggtccgttttggagaagttaggaattcgcgggtctaaccggaaaaagcgatctcccagaagattagcactgaccatggattcatagtaaccgtttccgccaccgacaatctgcagaaatggcagtaaaggttcattaggcgacctgtccaaaaggactccccaatttggaggaagattcttcagattttcgggacgtatgttatctgcacttaccattccccaccccctcgtatctcgtcttaaccgagtcggggcttcacctgttccaatggataatactgcaatttgatccaaaggcactttggcttttcctactgcaaacgcgatactggctgtactggggttcgttgctactacatatccgtccacgtagttttgataggcgcgttgtgtcgcgggagcaccgctgcttcgcagtatgacatcactcactttctcatctaaatagggagagccgggaaagttgtgaaataatacaggagtccaacgatccagtttaggagagtataatttgaatgaagggacaacaattcgtctttttaaatctttgagacgaagatctgccgggaaaaagtttcgtaccgctttaataaaaccggaatatggtaattgttgattgaaaacaggtccgcccggccgggaaatgctgaatgctggcaggatattttccttaaaatagcggaatgtctcctgcggtgatcttccgctggctaatgcaagggcagtgaatgaaccgattgaatttcccgaaaacacatgggttcggcttattaatgttggattttgtttaaccagtctgttcaatagttgtaaacttaaagcacctaaggtaccgcccccatcaaaggtcataatccgatattttgccaaagttaatttctcctttcaatttaaaactatcattcagtatatgtttctccagtgtctattgtatggatgaatgaaaatttctctaaaatgtgttgattaatcaaaataatagtccaagctgtgattttttatttacataatatgtaatgatttaatcatttaatcatatgagaaggagtgatggtcatgtattataaccaagatgaagatcaaatgttcattccgaagaaaaagccatacaacgaagcctgtgacattggtcatgatatggatcaggtggaagaagcattaagagcagaagcagcaagagaagcagaggcaagagcaagagcagaagaagcaatagcgagggcagaagaagcaagagcaagagcggcggaagcaaaggcggaagcaataagattagcagcaaaagccaaatgtaaaaagcgtcataagaaagagaaagaacatgattgcaaacgtaagcacaagaagaaaaaataaaattttaataatgtaaaagacttgaatcattttttcttgaaagaaaattttcaccgcggaaattcctgcatggctgttggaggagcaatcacgaagcttgctcagcagaactaaacgggcaggcataaaaaacatccggctcataacgtttagggaactgtctgtcggacagcctacaaaagtcaatatgttatcccagaacgttataaaaagtgagaagagacaagagagtggcagcttgccgcccttgtctttttttgtgtttttatagagggataagtcgatgatcaagttaagctttcgcatatatttatctatttttaagttagtagaccatctgtctaagaatttgtccaaatcctacatatactggtaccggaatcaaatgcttattgggagtgaaatagatgggatcagcacagttaacaggacgtgtaatcttcaaaggggaccccggctatacacaggcggttaagaattggaacccttatgttgatgtctatccgcttgtctttgtttttgcacaaaattcatacgatgtcagtaatgctattaaatgggctcgtgagaataatgtgcctttgcgtgtcagaagcggccgccatgctctggataagaatctttcagtagtaagtgacggaattgttattgatgtgagtgacatgaataaagtcctcttggatgaaaaaaacgcgattgcaaccgttcaaaccggcattcacgttggtccgcttgtaaaaggattagctcgggatggttttatggctccgtttggagacagtccgaccgtcggaatcggaggaattacgatgggcggcggatttggcgtgctctcacgatcgattggccttatcagtgataaccttctcgcactgaaaatggtagatgcaaaaggcaggattattcgagcaaatcaatctcacaatgaggacttactatgggcttccagaggaggcgggggaggtaatttcggatataacacccaatatactttcaaagttcatcgtgctcctaaaactgcaaccgtctttaatattgtttggccatgggaacaattagaaactgtatttaaagcttggcaaagatgggcgccgtttgcagatgaacgattaggatgctaccttgagattttcagcaaagtaaatggcttgtgccatgcagaaggaattttcctcggttcaaaacctgagctgattaaagcattaagaccgttattaaataccggaactccgacacaaaccgtaatcaaaacattatactatccagattgtatagatttcttagaccctgatgaaccaatccccggcagatccgatcagagtgttaaattttcctcggcttgggcgctcaatctttggccgcaagaacccatatcaatcatgagacaatttttagaaagagccactgggacagaaactaatttctttttcataaattggggcggtgcgataagcagagttcctagcagcgaaacagccttcttttggcgccggccattgttttatacggaatggaatgccagttgggaacataaatcacaagaagcctcgaatcttgcgtcagttgaaagagtgcgtcagctgatgaagccatatgtaacaggttcatatgtgaatgttccggaccaaaatattgaaaatttcggaaaggcatattatggctcaaactttgcaaagcttcaaagaataaaggcgaaatacgatcccgaaaatgtatttcgttttccgcaaagcatcccgccgtcttatcactagtgtattgttttgttaagcattctaaatatcatcaagttggaacacaccagaaaattcaggtgtgtttttatttttgcttttatttcttaaatgaaaagcactctccatcagaaaatagcatatcagttttctaatgtatcccagtgcggattccaaacgatttcccataggtgcccatcggggtcttggaagtgaccggagtatccgccccaaaaagtatcatgagcgggatcagttatagttgctcctgcctgttttgcctgatccattactttatcgacttcagctttactattaacattatgccctaatgtacattcgacagggcttggtgcggttaaagcaacgtttgcttcatgtgcgatgtctttgcgatcccaaatggcaagtttcagtcctggctgcaagtcaaaaaaggcaactgcaccatgctcaaactctttaccgactattccttctgtaggcagacccagaccatctcgatagaagtgcagcgctttttctaaatgatctacacctaacgtgattactgtaatctgtggtttcataaaaatgcagcctcccatgctcatgataagaaaattatatcaatcattgattaggagagacagcggaagttatttaattattcagtttgtttttggggatgtaaagagggtattggaaatcttcattaaaaattatagtaaagaacatttatattcagatatgaacacatgatcatatataattgtttgtgtgtgacatgttagaatgcttcataacagaaaagaaataataaaagcatatgcatcaagaaattttaggttaaggaggagatttttatgggtcacaatcatactgatggggccaacaaaaaggttttattgatctcttttatcatgattacaggttatatgattatagaagcaataggcggatttttaacgaatagtctggcgcttttgtcagatgcgggtcatatgctgagtgattcaatctcattaatgattgctctgattgcttttaaattggctgaaaaaaaggcgagtcacaataagacgttcggctataaacgatttgagattcttgcagctgtgataaacggtgttgcattaattcttatttccctttatatcatttatgaagcaatcaaacgtttctctcatccgcccgaggtagcaacaacgggcatgcttatcattagtatcatcggattagctgtgaatatattggtcgcatggattatgctgaatggcggagatacaaagaataacctgaacataaaaggagcttatttacacgtaataagtgatatgctcggatctgtgggtgccattctagctgcgattcttatcatcttctttgggtggggctgggcagatccattggccagtgtcattgtggctgttcttgtcctaaggagcggttataacgtgacgaaagatgccattcacgtattaatggaaggaactccagaaaatattgatgttactgacatcattcatacaattgaagagacagagggcattcaaaacattcatgatttacacatatggtctatcacaagcggattgaatgctctttcctgccacgctgttgttgatgatcagctgactatttcagaaagtgaacgtattttacgcaaaattgaacatgagcttgagcacaaaggcattacgcatgtaacgattcaaatggaaacagccgcgcataatcacgacaatgcgattctttgtcaggccaaaagtgagcagacggacggccaccatcatcattaaatttttatctgatttgaatgcagagatggatgggaacgttaaatggtatttctcatcgattgatgcaggatgacggcacccagccagcggctgttttagaaaaagactaactcttggagctgaatgaaagctttccgggatgtatacgcttggtaagtaaatttacagagaattgtttagctcacgcacatagaaaagctccttgttaaaggagcttttctactctttacatatggttcatataaaatgtttgctttcactccccgcccagcctttctcatttaatcctttcaagcacaagtcgaaacagctcaaataacaggaagttaaaaaacatccaaaccccgccgtatacatatccgcccactatgtcgcttggaagaacgcttgtccatttaatatttacaatcgcgagacctattaataacaataatccaaataaaggagccgcaatggtcacataatgtgtgtttgaatgacgaacaagcaaaaatatgcaagttccataaatgataatcatcatagctgcattcagatccggaaaatcggcagaatgaaatttccccttaaaaccaatcgttcgaaggatagagaaggcctccataataaattcacgaaaaggggctcctccgagtatggaaaccgataataatagatactccagcagcctattctgattcttcaaccaaatgactaatagggttaaaacgatgaggccggcgatgccagcgggttgttgaaaaatgaataattctttcatccagtccatataaaaggcagtataaacgacatattccgcaatttgattaaactgggcaacgtcatttgcaagataatcctgagctaagccaaacatcaggatcacaaatccaattaaaactgacgtgaggcaagtaaggaatatttcagtggctcttatcgttctgaatcgatttgttaatctcgtcagccattggataaaaaagtttttaatctggattttataaaatctaaaaagaagatatcccgctaacaaaacagccagaacaagaagaaaaatgattaaatatttgcttgctgcctgatgtaaggtttcccatttaggacccaataatttccctaaagtaataaaacagcttccccacaaaatggccccaatgtaagcagggataataaatgtctggaatgacattctggaacttcctgatacataaccggcaaaatgcctgaccccgggaatgaaataagcgaacacaagtaatttacttcctgaccgctcaaaccaagccgctgttttgttatacctttcgggccctaaatgaacatactttccataccgctcgattaatctatatcctccggttctgccaacccaatatgtgattgttatccccgtgcccgcggaaataaaggcagttagaagtgctaaagcataatccatttttccttgataaacaaaataccctgcatagctcatgatcatctcggctgaaattggaatagctaagagctctaaaataataccggaaaataaaatcagataactatgttgttcaaataaagttattaaatgtgacataaaagcctccggatttttatctaacaccgttaccttgatctgcaaagtatcattatttttttagtaagtttagcattttcagaaacttgtaagtttttaataggaactagtttattgtatagagtaaggatgcccgattccgaaaaaaatataacatcagtccaagcaattgcgatgcttactcatatgtaaaagcgatttttaaagctttaacttttaatgcaaagctgacgggtttatcaattgcttcgaatttttgtcacctcttctcattacgtatcaaaatatagtaagtttgtggagcagagaacagtatcattgagggacaatggatgagtgacctgcggaagttcaagttttctcagtcgtaatcatgataaggggaaaattccttagcgtggcacattctcactgtaaaagcataggataacatcataaaaatttaaaattgcggggatgaaaaatgtattatatacctttttcacatcaatgttattattgtgtgaatgtaccgatgtatagcgatggaagatctgtttattggactgttccaaataactatgatccttcatacgaagatagaaaccttctcttgaaagattatggaccaaaaccatttgtcgtgaatatcaataaagccgcaaaacaaaatcatacgttccgtactgccttatggaccggaaaacattttcaaattactttgatgagtatcggcattggagaagatatcggtttggaaatccacccccacgtagatcaattcttacggattgagcaaggccggggaatcgttaaaatgggcaggagtaaggaaaatttaactttccaaagaaatgtctatgatgactttgccattgttgtacctgcaggcacttggcacaatgttattaatacgggtaatacgccgttaaaactatattcaatttatgcgcctcccaaccatccatttggcacggttcatgcgactaaggcagatgcagaggctgcggaaggttagcataaagtatactgcagaggtttgacaaactgggattccgcctttctggctgcctaagagtatggtaaataaggccgatttaatatgaatcggcttattttttgttggatttattttctttgaacagccttggatcgctgcgggcaatgtatcggttttatcggccttaaattctccggtataccccggcacgagtccaatatggccttcttgattaggcttttcagcaaagaatagctttttcattcatttggcaaacgttattgatttatttgcggaataacatataatggaaccgtcaaaatataatctcgttagaagggagattcatatgattattaaaatgactcaatgtcatatgaaagacttcaataaaccaaatgaacctctggttgttttcgggagaattatacccgcacttgaaaacaatgtgtggtcatatactgaggaacggttttctaaaccttatgttaagaaatatgaagatgaggatatcgatgtcagttatgctgaagaagaggggaaagctgtttttttgtattatgctgacaacaactgcatcggccggattaagattcgtgcccattggaatgggtatgcgctgatagaggatattgctgttgcaaaagactatagaaaaaatggtgttggaacagcattattaaatagagcgatggagtgggcaaaggagaatgattgttgcggtcttatgcttgaaacacaggatattaatgtgtcagcttgtcatttttatgccaaacacggctttgtaataggcgcagttgatactatgctttattccaacttttcaacggcaaatgagatcgcgattttttggtactgtaaattttaattgctgctgaattttaaacgggcactattgtgtgcgtattgaggaaagacgaaaaatgcagacagggctgcaaaatggtgcataaaaaggaagggggcataatccttccttaaaagaatcttcaataccttttacttctttgtataacattccttttttgaaatcggcacccaaatttcgcttttgaaagatggcgatgttatatccttatgctcgttccacagtatttccgggccttctacttgttcataatttgacgatggaaaccattcggaataaatccgtccccacacttcttgcagcgcatccgggaatgatccgattgcttcgaatacagcccacgttaaggcaggaactttaagctgcgataggtgatttgggcaatgtttcgtcgttgctgcgccaatatagtgatcaagctcccctttctcctctgtacggccttcagaaaagtttgtggatgcactaatgagtcccaaaggtgttgtattagaaagctctttaagttcatttattgtttcttcatctaaactttcccacatggatgcaatatccggattcacccctttgaaaataataggaactcttttcttaatgccaacgatgcgaaatgcctctttttcttcgatacgatagttcatttcatttcctcctttgattgataactggaaggtcattcgtggataagctttaagtgaatggccattatgtttagcttcagatggtcttatgccatgcaaatgttgaaatgctcgagcgaaagaatctggtgagtgataaccgtactttattgcaatgtcaataacctttgcgctgcggtctttaagttcaaaagctgcaagagtaagacgtctgcggcgaatgtattccgataatgaaatacccgtaaggaaagaaaacatccttttaaaatgatattcagagcagaaagcaagctttgctgcttctttaaaatcaatatcgttcgtaaggttttcttcaatatacgttagcgcactgttcatacttttaatcgaatccattttattgacctcctttaacaaaagaataacaggagcggcgtgtatctgcccgacattccgtgcacggttttgcagggttaataaaaaacgttaccatgctataagggcatttcatacggtatcttatctgaaactgtatctttttaaatgtcagtcgatgtaataccctgcaagccatgcagaatctaaatgctgcaatccctgccccttagcttattagataataaaccggtcaatctggagcaattaaacgaactgatcgatgaagtgacataaatataaaacattactataagaagattggtattcaagcaggcagttatagtcaagcattgttatgttttaaactttacataggggaacccttatgatatggtgattattactaatattgacaataaagaggtgaaagcaatgataaccgtttttagaattttgtatggttcagatgcaaaaattggaaatatcttggccgacaaagggagcagtctgtccttttttaagccaaataaccataaaaaaacagttatcggcgctttttctctttggcaaataaacgttaattcaatgacatgatgtccttgtttatttgtgcatgattttatttaagcgcagcaccgataattgtgtcggtgtttttttgtgcctaattttaaaaaaggttagatgatgactcccttctatttactcaaacaaacgagagttttatggaaggatgagaaaacatgcgacaaaaaaacaagtatataagaattcaagagttcttgaaacagaatgaatttcctgattttagaatgaaacaaatcacaaatgctatattccatgggagaataaatcatttcaatgaaataacggttcttcctaaatcgttgagaaaaatgttagttaaggagtttggagagtcggttttaaatattgctgctttaaaagaacagcattctgagcaagttacaaaagtcttatttgaaatttcaggagacgaaaaaatagaaacggtaaatatgaaatataaagctggctgggagtcattttgtatatcctcgcagtgcggttgtcattttggctgtacattttgtgcaacaggagatattggtttaaaacacaacttaacgtcagacgaaattactgaccaaattttgtactttcacttaaaagggcattcaattgatagtatctcttttatgggaatgggagaagcattagccaatagacaagtttttgatgctttacatgtacttacaaatccggagttgtttgctttaagtcctcgcaggttatctatttcgaccatagggattattccgggcattaaaaaaatgactcaaaactatccgcaggtcaatctgacgttttcattacattctccttttaacgaacagagaagcaagttaatgccaattaatgaacgctacccgttaatggaagtaatggacacattagatgagcatatacgtgtgacctcaagaaaagtttatattgcttatattatgctgccgggagttaatgattctattgaccatgcgaatgaagtagtaaagcttttaagaggcagatataagagagggaacttgttccatgtaaacatcattagatacaacccaactgttagctcacctatgagatttaaagaagtaaatgaaaatcaagttgtaaacttctataaaacattaaagtcagcaggaattaacgttaccatcagaagtcaatttggcattgatatagatgccgcttgcgggcaattatatggtaactatcaaaaaaataatagctaataaagatgagagtcatgtttctaacgtgggaagcatcgatacggggattgtgataagaggaatggagtgacagaagagaacgcgggaaagtgacggatacgatatagcggaggggttttatcgttagtattagttccggcggtgatatagctttagggcaggaaatgacacattgacttcatattatttcatttgataacataaaatggttattttagtgaagaatcaggatatccattttgataaaaaaaaggagtcataacgttgttgaaaaggttttttcttgtttttcttacgctgatgatgtctatatttgctgtactcgcggctgctgaagagtctcccggcgaacatgtcatttcatttgacgagcctataattttattggtatcactcggaatcattttatgtttattcctccctccgttagtcatgtccttttttggcagcttgattgtgagaatcatatccggagtctatcaatgttttatcgttctcactttcgcagggctcatcccaattggatttcttattcccaatggctatttgacacttcttgttgccgttgcgggaactttggtcagttcagccagtgttgcggtcaccttattcgctggcaggacaaagaacacaaggaaagttagaaatgatactgaaactaagctttcgtaggcggtcccaaaaacaccaagtgttacagacacttggtgtttttttattccggcggcgccaacccgattcttataaacaaaagaaggtataatgggcaggggagggttgccagccaatgaaaataaccagagaaaaattagaaaatcagcaaatttggatatatggtgtgtctcttgtgatcggaggaatagcggggatcgccgggaaagattcaggactcacctggggctggacgatatcaccgcttattgctgttctcatgtatgccatgtttgcccaaattcctttcttaaaactgagggaagccatttcaaacctcaagtttatggcggcattactgatcggtaatttcttagctgtacctgtcgttgtgtgggttttgaccgccatttttcctcaatctccgcctatattattaggagtttgtttggtattgcttacaccttgtatcgattacgtcatcgtctttactcagctcggcaaaggaaatgagaaattaatactggcttctacaccggttttgtttgtcgttcagatggtcttgctgccgttatacctgtggctgtttatcggaaaagaggtcgtaggagctgttcatgcggggccgtttctggaagcattcttatttttaatagctgcgccgctgctggcggcagtcatgactcaattatgggctgataaaaagccggcgggagaaaaggtgttagaatggacagcgtggatgcctgttccttttatggctctagtcttactggcggtcgtcgccacacaaatcggcaaagtttacagtgattttgacatcattgtacgtgtgattcccatctatctgttattcttgctcattatgccgtttgtttctcggtttatcgcatatgcatttcgtttggatacaggtgaaggaagagcactgatcttcagcacgggcacaagaaattctctcgcagttcttccgttggcgctggccttgccggatgcctgggcctcactggccgctgctgttatcgtcacacagacgattgttgagctgataggcgaattggtttatataaaagcggtgcccgactggctgctgaaataagccgtgttccttgtcgggcggattccgtctgaactgaaaaaaacataccaatagatattggtatgtttttatgcggattataaagtcgaaatatcaataacgaaacggtagcggacatcgctttggagaacccgttcgtacgcttcgtcgacttgattggccggaatcacttcaattttaggagcaatgccgtgctcagcggcgaaatcaagcatctcctgagtctgcggaataccgccgacaagtgaacccgcaatgctgcggcggcccgtgattaaggagaatacactgtatgagtccggattagcaggcgctcctacatttactaatgtaccgtcaatgcgaagcagggataagtaggcatctacgtcaaggttcgcggacaccgtatttaaaatgagatcaaaacgtccggccagctcagtgaatgtatccggattgcctgtcgcaaagtaatgatcggctccaaattcaagagcttcgtcctttttattcattgagcggctgaggacggtgacctctgcgcctaaagcgtgcgcgaattgaacggctaagtgtccgaggccgcccattccgacaatcgccacttttttgccgggaccggcattccagtgtttcagcggggaatatgtggtaataccggcgcacagcagcgggctggcagcatccaattccagctgatccggaatccggacaacgaatctttcagtgacaactattttctggctgtagccgccgtacgtaggatttccttcgtagtccaggttattataagtctgaacaacaccttttgtgcaatattgttcgtcaccgttgaggcagtattcacactctccgcaggagtctacaaaacagccgacacccacgcggtcgccgacggcaaatttggtgactttttcgcccacggcttctacaacaccggcaatttcatgcccgggaaccatcggaaaaattccgccgccccattcatcgaatgcactgtggatgtctgaatgacaaatgccgctgtacttaatgtcaatcaggatatcgtgcggccgtaatgctcttctctcaatcgtcgtccgttcaaatgcagcttttgcatgcggagcgcttaacacacgagttggatgattattgcacatggttatcttcctttccgaaataaagtggtgaatcctcttttcaattttactttaaatgttaaagcggactttaagtcaaggcatttggtttatttttttatgaaatgatattctataatggcacgcttatgaaaggtatgatagatgaaggatgggtggtaagaacatgaagattgcacaagctgcaaagcaggttgagttatcaaccgcgacgcttaggtattatgaaagcataggactgatccctccggtaaagcgcaatggaagcggcatccgcgattatgatgaaaatgatgtgaattggattcaatttataaaatgcatgagaagtgccggcctgtcgattgaggcgctgattgaatataccgctttatttactgaaggagccgatcatacgattgaaccccgaaaaaacattcttataaatgaaagaaaaaggctgaaggagaaacagagagaaattggtgaaaccataaataggttaaacaagaagattgaagactacgaagacatacttgaaaatgaagcgaaactaaagggcagcttgaaagctgaatgtatttctgagtgaagaagatgacctgagcgccggccgcaagaaatgtactaagggaacaagccttggtttttttattttctgctgactttatccgcatctttttgggaaaatataaaaaacccacaatagagagaaatgaatctaatttaatctttatttatccttttttcagcttgactttttcactgcagacttttaaagtgtgaaatgttgcttagactgtgattagcgactttaatgctgaaaagaggtggtttacccagatgaacaataataagaacccttgggctttattgccattagttttattcgtagggctttttgtcggctctggtctggtgaccggagatttttataaattgccgatcttgattgccgcgatcattgcatcagcttttgcgctgttatttaaccgcaagaaatcgctcaatcaaaaaatagaatggtttgcttccggtgcgggacatcctgatattatcattatggtgatgatttttatattggcaggtgcctttgcttcagcggctgaagcgatgggtgcggtgcattcaactgtcaatcttgctttgagcattattccgcagcagtttttgctgccggggctgttcatcatttcttgtttcatttctatatcgatgggaacatcaatgggaacgattgcggcggttgccccgatcagcgccggtttgagcggagagctaggcatcccaggcgcgattacgatggcggccgtcgtcggcggagctatgtttggagataatctatcctttatttccgatacgaccattgcgtcagtccggacgcaaaaaacacaaatgagagataaatttaaaacgaactttctgattgttttgcccgctgccattgtcactgttattatcctattttttattccggcaggccacgcaggccatgcgggcgctgaatcttacagctggatcaaagtgcttccttatgtcgccgtgttagtctttgcgttaatcggttttaacgtaatggctgtcatattcggcggattggttttaacgggaatcatcggattagcgggcggcagcctgacgtttgcatcttattttaaggcgattacggatggaattgccggaatgtccgaccttatcatcctgtccatgctgatcggcggaatggtcggcgttatgaaacaaaacggcgggatcgactttttactggagttcattacgaaacgaatccgttcgaaaaaaggcgctgaagccggcattgccggtctggtcagcgtgacgaatctggctgcggccaataatacgatctcgattatcgcagccgggccgattgcaaagaatatcgctgatgaatttaagatcgacaacagaaaatcggcaagtattctggatatcttttcgtgcatggtacaagggctcattccttacggcgcgcagctgttatcggccgggaaattcgggaatatttcacccgtcagcatcctgccgtactctttctatcccgttctcatcggaatctgcggcattatcgccattatgtttggcttgccgaagtttacaagaaatacgaaataaaaaaggcgtcgaatggcgccttttttatttcatgtcagccaggcatgtttcaaaagctgaatgccctgcgcgatctgatcagtatcaagatgggcgaaccctaactttatgatcggcggttcaggctttccggaaacgaaatagatggcggtagggtataccttcaccccgtactgaaaagcgcgctcgattaatgtttcttctgaatagttcaggtgaactctcaccaatatatacaaccccgactgctcgccgatgatcgtcacatgatcgccgaactgctgcttgatatgtgaaatcaaatgctgcattttgcgcttgtagacagtgcgcatgcgtttaatatggcgggtccactcaccagccttcatcaattcagccatggccagttggttaagcgaagaagcggtgctttcaaaataaagaaaccgttttttataccggtgtaaaatgcgctgcggcaaaaccatatagctaatgcggatgcccggaagaaaggattttgagaaattccctaagtaaatcacacggtctgattgaatggaggcaagagcgggaaacggctgctgcgtataacggtattcactgtcataatcatcttcaagaatatatccttctcttttattcacccaattgatcagtgtttggcgctgctgaatggacatgcttacgccgtaagggctgtgatgggaaggggtcacatagattaatttttctttcattgcgtgtaattgagaaaaatctgctccgttttcatagacaggcatcgtttcaagtgacagcccatgaaattgaaatgcctctctggcaccgtcaaatcccgggttttcaacgataattccggaaaaatcttctttcagaatccggctgagataaatcagcatctgctgtgtgctgctgccgatgataatggaatccgcgtctgttttcaccccgcgggattccaagagataagcggcaatttgttcacgcagatccaactcgccgaatgggtcaccgtacaggaagcttttctttgatgtcaaaacttgattgtataattttctccatgttttcagagggaaatgcttttgatcgacggctccggcgcgaaaatcaaccgagaccggctgcggcgattctgttttctcagcttgaacaatatcattttcttgttgaaataaagagggttctatttcgtttgcaaaatatcctttgcgcgtttcgccgcgaatgtatccctccgctaaaaggagatcataggccatcagcgttgtattgcggcttaccagcagggaatccgccagctcccgaatggatggcagccgctcatttgcctggatatttccctgctcaatcaacgtcttaaattgctcgtaaatttgtttatatttcggggcgtcgcttctgaaagcaaaaattatatttttcatcagatgttctcctctgacatgtatatttatccgaatctgtatctttttaaatgtcagtcgataccttattatagcggaaagcgctttattaaatccatgttcagagaggagaatttttatgtatattcccgctccatttcagcttagtgaagctgatgcgagtaatgtcatcaaagagtatggtttcgcaacattgttttccacggcagggggcatgccatacgcaacccacctgccattgatgatgagcaaggataaccattacttgtacggtcattttgccctgccgaatccgcaatggaaagagattgaaggccaaagcgtgttagccgtttttcaagggcctcattgttatatctcgcccaaatggtatgagacgaatcaggatgttcctacatggaattacgtggcggttcatgtttacggagaggcggagcttttagataatgaagaaaccgtgcattcgatgagtgatctcgtattgaaatacgaaagccccgacagcccgtataaattagaggatatcgatgcgaaattgctggcaggcttgaacaaaggggtaaaaggctttaaaatcaaaatcagcaaaatagaggggaaagcaaagctgagccaaaatcaatcagccgcaagacaagagctggtcgtacaacagctcaaacagattcctcatacaaatgaacagctcatttccggcctgatggaagaaaacatcaaacggattactgaaaaaaactaaatgaaactcaaaaacataccagcagaatgcggtatgtttttttctggttatcaagcttttcttgggatgaataacgattcaaacaggaaccgcatgaagcaaaatttttcatgaagaatacaccaaaaataagctgtcagcttggtccctgacggcttattcttggcgaaagattatttctctgtggcgaaataaagcaaagcgatgaccggaaaagtgataccaatccataatgtgatactccaaccgcctgaagcatatgcccatccgccgattgatgaccctatagcaccgcccagaaagaaaattgccataaataatccgtttaatcgactgcggacttcaggccccaacgaaaaaattgaacgttgactgagtacgagattggctgatacacccacatctaacagaatagctgccgctactagaactgctattccgacgggggagctgctctgaatcatgagcggcagtaataaagaaacagtgacagcaccgagagcgattccggtggcaagccgggtcaagccgcgatcagccagacggccgcctatcggtgcagcggctgcacccgcaatgcccgctaatgcatatagcgctattgccttctgagaaaaatgaaaagcaggaccggacaataataaaggtacagtcgtccagaacaagctgaaagctccaaatacaaacgcatgataaatggcacggcggcgtaagaccggagtcgtgcgcagcagcttccacattgaaccgagtaagacggtatagtttgtgtttgctgttggttttctggcaggaagcacttttgataacacgattgccaggacaacacttaacgcggcggataaagcaaatatggcattccacccccaaatatccgcgaccagactggatatcggacgggacagcataataccgagcagcaggccgctcatcacattgccgacaacccggccgcgtgcagcgtctggtgcaagatatgatgcaaacggaacaagcacttgggctgcgatcgatcccaatccgatgaaaaacgcagcggctaaaaacagtgttccatgcttcacaaatgctgtcagtgtcaaagcggctgcgcttagaaggagcgatacaacaacaagttttttattttcgataatatctcccaaagggacgagaaacagtaagccggcaacgtatccaatttgggttagtgtgacaatcaatccagcactgctgggagaaagcccaattgccgcactaatggatcctgccaagggctgcgcataataaagattagcgacaatgataccgcatgcagtcgcgagaagaagggttaaaccagatgaaatcctctgatctgctgtttgtttgttttctttagccataaaaatgaactcctttttaagtggtttttaatgatgcttgataaatgatttgctgattctaagacttcctcaggttattttataaactaaacgtttagttttaatcataagcaaatgatatactgaacgttcagttttgtaaataggtttctgttttatttttttaatcatgttacgtatactgaacgtatcgtttatatttggggaaggaatgattcatgtgcagaataaacgagggcggccgcgcgatgaaggaacgcataaggcgattctttctgcagcttatgacttattgttggaaaaaggctttgacgcggtgacagtcgataaaattgcagagcgtgcaaaagtgagtaaggcgacgatttataaatggtggtcaaacaaggctgccgttatcatggacagctttctttcgacggctacggacagactgcctgtgcccgatacaggatcaacagtgcaagatatattgacccacgccacgaatttagcaaggtttttgacaagccgtgaaggaacagttattaaggaattaataggtgcgggacagctggatgcaaaattggcggaagaatatcgcacgcgatttttccagccccgccgcctccaagcgaaaggccttctggaaaagggaattcagcaaggtgaattaagagagaatcttgatattgaagtaagcatcgatctcatttacggaccgattttctatcgtctgctgataacaggtgatgaggtgaatgattcctatgtgcatgatttggtgatgaatgcatttaagggagttcaagctacctgaataatcgctcgaatcggatgcaaagatatttgtgcctatggggcagaaaataataaaaaagccgaacaagttcattgttcggccttttctggtttatttgcgaaccgccgggcggctgccacgcaagcgataacgccgacattcaccgctgcaagtccccatcctactttttcgtgcagaatcatagcggccagtaacaggccgaagaaaggctgcagcagctgcagctgtccgaccgccgcgataccgccttgggcgagtccccgataccagaatacgaacccgatcagcatgctgaataaggacacatatgcaagacttagcagtgcaggcgcgccgatgtttgaccatgagtgcggaataaagcagacagacagtatgaacataaggggaagcgataaaacgagtgcccaagagatcacctgccagttgcccagccgccgggagagacgggcgccttcggcataaccgagaccgcatacgataatcgaagcgatcatgtacgtatcaccgagaggagaggattctcctccttgaagcagagcataaccggctacgaggatgctgccggcagccgagaaaatccaaaagaccggactgggccgttcgcctccgcgcagtacgccgaagatcgccgtcgcaagcgggagaagcccaatgtagacaatggcatgtgcggaagtgacatactgaagcgctaaggctgtaagcagcgggaaaccgattacgactccgaccgctactgttagtagtgagatgatgtcgcttttggccgggcgtttctccttaaagatgaggagcagagcgcctgccaatataccggctatcgcggcgcggcatacagtgagaaataccggatcaaagtccgctacagccaagcgggtcgcaggaagcgaaccgctgaaaataagcacgccgataaatccgttgatccagccgtttgcggctttgttcattttcaatcactccaacataaaatttgctttatccggtttgtgtttctaaatcgattttcaaagtttataatgactataaactgaaattggccttatacaaatggccagtttttataaaaagaagaatgccagtttgggggaggcagaatggatattacgccatttttaaatagagatctgaatattccgctttatcagcagctttatcggcattttaaggagaatatgcatcagggccgtattcctaaaggactgaagcttccttcaaaaaggcttttgtcgagtcagctttctgtcagtcagacaactgtagaacgggcctatgatcagcttgccgccgaaggctatattgtcagtaagccgagaagcggatggtttgccgattatgattcagaagctgtctatgtgaagaagaagccgggcgcttcacccgttcaaagaaagacggaggaagttccgcaatggattgatttccattacggcgctgtggatgccgtgcattttcctttttcggcatggcgcaaaagcatggtcacaagcttggatcaatatgggcatgagctgtatcggcccggggatgatttgggcgaggctgagctgagaacgatcatttcagagtatttatatcaatcgcgcggcgtgaattgccttcctgaacaagtcatagtaggcgccggaaaccctattcttctgcaaatgctgtgcaacgtatttgaatcgaatgtttccatcgggtatgaagatccgggttacccgagagcgagggagatttttgaagccaatcatatgaatatcacaccgatacccgttgatgaggaaggggtctgtattcggaagctgcaggaagagcggccgcgtctagtgtatgtcacgccttctcatcaatttacgttagggacgattatgccggtaaacagaaggattcagctgctgaaatgggcggcggaacaccaggcgtttattatagaagacgattatgacggtgaattcagatacaccggccggccgatcccttcattgcaagggcttgatcagcatcaccgtgtcatttatatggggacgttttctcaatccctgcttccctcgctgcgcatcagctatatgattcttcctttgccgcttatcgaaaaaggcagggaaatcgcttctttatataaacagaccgtctcctgccacagtcagctgacgctggcccaatttatcaaaagcggagagtggcagaaacatatcaacagaatgagaaagctgtaccggaaaaaaagagcggtattattagaggccgtgcggcgcgagctgggacaatacgtaaggattcgcggagaaaattccgggctgcggattttactggacgttcagctgcctttcagtgaaaaagagctgattgaaaaagcaaatgaacaaggggtcgtcatctatcccgtgtctcatacctatcaaaaacagctccctgcgaaaacagtttccctcgggttcgcgggagtttctgaaacggatatacaaaacggcataaaaaaactgagagccgcctgggcgctgtaaaaaaagattgctgaggacagcggcattcatgctgaactgtcctcagcagcaaacgtttatagaacgggcaggcggagcacagtatcaatattttgtaaattgagctggatttgttcgtttgtgttccacggatgataccaccctttttccatcatataggttgagatttgctcgtgcatgtcaagggcttcttctaagtgccgggtgaggatcgctttcacttccggcgttcctgcttccgtcgccgccatcgcatagtttctgactccgctttttgccgaattcaataaatccattgcgacaatttggtctgtcagtgcatccattcccgtcaggtattcaataatcggattcattcgtcattcatctcctcattcatgctgttgatcagataaaatcgaggcaaattcctgcaattgcctagtagatgtatccacatcctgctgcatgatttctttcagatgcggatcggataccagcgctttcatggttttggatttcgtcagacaaagtgatttaaaagacgtcatctcctgaatttcgagtaattcatgtaaggcgcgggccattttctgtagcctccgttctctaaggtttgagtacaacttttatgcaatcatctgttttcgtgtcaaacatctcatagccgtgtttcgcttcgctgagcggaatgacgtggcttacaacatcgcccggatcaatttttccggttgataccaattcaaacatatacggcatatagtggatgaccggagcttgtcctgagcggatattgacgttccgctgcatgatatcgccaaggggaaaaccgttatatctgccgccgtacacgcccgtaatctgaatcgttcctccttttcgcaccgcttgggaggcaatgaccaaagcgctcatagccccgccatgaagctttaatccgcttgcgaggaactccatgtctgtcatttttccgtccatgccgacggcgtcaatgacaacatccgcgccgcctttggtgatttctttcaggtagcttcccgtattttcgtggtcttcgaagttaacgatttccactttattcgtccgtttggcatgctggagacggtagttgacatagtctacagcgattacgcgtttagctccttttaaccagcagaatttttgagcgaacaggcccactggcccgcagccgagaacgataactgtatcgccttcttttacgccggcattgtcaacgctccaaaagccggttgtcatcgcatcggcaatcacactcaatttctcatcaggttcttcacacgtttcggggactttaaaatgggtaaagttcgcaaaagggacgcgtaaatattccgcctggccgcccggatagccgccggtactccctgaatagccgaaataagcgcccatatcgccgttatcatttgattgatcacactggctttccaggtgatttttgcaataagtgcattctccgcaggcgatattaaaaggtataatgacacggtcgccttttttgactttcgtcacgccggggccgacttcttccacgatgcccatcggttcatgcccgatgatgtagtcttcctgcaagttcgggatgagtccgtggattaaatgtaaatctgagccgcaaattgccgtacttgtgacttttataatcatgtcatcatgtttttcaattttcggatcaggcacgtctttgactacaacgtttttaactccttgatacgttacggccttcatgctgtaatacctccagtattagtgttcatcaggtgtacggtcaaacattccttttctgtttgtttcaacgggaaacaggttcatgtttccgaccatgagggtatttttcgctgaaagctgatccaatttatactgttcgctcagatcatgcgggtgaaaccactttttgctgaccatcaagtctgtaatctcctggtgcatcgcgattccttgcatgagctgtttgcgcagcaaagcccttacatcaggtgaagcggtttccgttaaagcgacggcggtatttctgacgccttctttggcgcgtatgagaaaatccattgcgaatgtcatatctgcgagttcagggacatgtaatgaattgattggatctaaatggtcatgattcaatggtgcttaccttcctttcagttgatgatcggtgtcggccggttttgaggaacaggagcctgaaaaggtgcacgttcataaaccgtctgcagatcagccagatcttgagaggcctgctgaacatctttttccattaacgttttcagatcctgatcaaacacaagcccttgcatgagcttggatttcgctacacaaagcgtcttgaagttaattatttcatgtaagtcgagcgactcatgagccgctaattcacgcttatccataatcgtctgtagcctccttttctagaaatacgcagttaattttccctgagaaaagggatctagtcttacaaattttgtttatcaggatcgaaaagtgccgcgcatcccggaaaaaggcaaaaaatccggtacaagccattcatgccggattaaaacataacggacctgtcgtgacagcggcggggctgattatgattttcgtcttcgcaggatttatctttgcgggggaagctacgatcaaatccatgggattggcaatggcattcggtgttcttttcgatgcgttcattgtaagaatgaccatcattccgagcgtcatgaagctgatgggacatgccgcttggtatttgccgaagcggctggataaaattatcccaaacgttgatatagaaggccataaactgacacaaggcaaaatgccggagaaaccgaaagaacagaattgaatataaaataaaaaagcagatcatcgtgatctgcttttttttatgtgccgactgcatccataaacagagaaaaaagctttttcatgtcttcatgtttctttgtcagcatttcaggatgccattgcacgccgacgacaaataactcacccgtccgttcaatcgcttcaatgactccgtctttcgcataagccgcggccttaaacgttgaagctgtctcttttatgatctggtgatggaatgaattcacacgcgctgaatcgccaaacaaggaatgaagacgggtccctttttcgaaagaaacatgatgggtttttaacggaggatctttttcttgatcatgcttgatctcagcaaacgaagcgtgtgacaggtcctgatataaagtgcccccgaaagtgacatttaacatatgcatcccgcggcagatcgccagaatcggcttctccatagcaatcgccgtttgaatgagctccttctcataggcgtcccgatcaggaaaggtctttctcaaagcctgtaaaggttcctcgccgtaaagcagcgggtctatatcctggccgccggacagaatgatgccgtcaacctgagagacctgttcctttaaaagctccgtctcttgaatcaccggcaaaataaacggcacgccgccggcttcggcagcagactgaatataatcattattgacatacgcccgattataacccgggaaaggaccggattgatcagccatgatgtttcccgtaattccaattcgtttggccattcttcgccctcctgaaccatgctcataataatctgaatgtaggttgtacaaatcagtttgaaattattcttttctatacgtaaactttccaaaaaaaaacccgtgagaatcacgggttttttgtactcatttcaatttcttgatctcttccgtcagctctttgaatttttgatcaagctcagaatattgtttatcagccggagtcatgaagctgagctttccaagcacttcctgccgttcggtttcgagctttaatcgtaattcttcaatatcatctctggcggcgggggattctttccattgttttcggacgctgccgtttgagatatcaagccggatgtccgttgttttttcgagaaagtaacgatcgtgcgatacgatgatgagcgttccgtcgtattgagccaatgtgtcttcaagctgctcgcgtgacggcaggtcaaggtggttggtcggctcatcgagaatcagcacatctttttcctccagaataaatgccatcagcttgcatttgacccgctctcccatgctcatcttgccgataggctccgtccattgcgctgcggtaaatcctaaatgcttcatgagggcttgcacatttccccttgcttcgaacgtttctttgtaaaaaagctgttcgggggttttgtcaagcggaaggtcaaatacttcctgcgttaaatacccgacatttgcagacggagacatccatatgctgccgccctgagctttttcctgaccgaggatgaccttcaataatgttgttttcccgctgccgttcgggcctgtaatggcaatcttttcaccgtgcaaaacagtgaaattcacatttttgaacagcgttcggccgtcatacgattttgtgacatcacttacttctaaaaaacgctttcccgcttttttgcggtgttcaatggaaaagcggacttcatactcagcctcaaccggttctgctttcgctttttcaagctctttttcaagacgcttctgctttgatttaatctgcgcgtccgtacgttttgcttttacgcggtggtattctttaaagccttctattttcgttgattgggcgtgggctttttttgaccaggcgttcagctcgttcatttgagcttcaatccgtgcgatcatattctgctgattctcataattccgctgctgtgtcagtcttctctgtttgcggacttccatatagcttgaataattccctttatgctcaatgagtttctttccttcgatggcccagatttttgtcgccgctgcatccaaaaaagcacggtcgtgggaaaccaaaataatggtgcctttatagttcttgatctgattttgcaggatttctaaactgtgctgatcaaggtgattcgtcggctcatctaataacaaaaggccgcttgaggaggagaaccctttggcaagacgggctttcagtttttctccgccgcttaattgggaaaaggctcgggcgggcacgttccatttttctaataatgctgcctccgcaggctccggcaggccggaatcataagcttccgtttcttgttcgaccatatagatgttcacatcttgcatcatctggatctgtccttgtgacggtgctgtttgattgcagatcaattgcagcaataaagatttgccggcgccgtttttgccgatgacaccgataatctctccctgctgaacactcgcgctgatctgttcaaaaaggggaacactgttgatttcataactgattccggttaattttaatatttctttcatatgtcaatccctcgctttaagggaggacaaaaaaatcctcccaattgatttggaaggattagccgtacctgtgcatgatcaaataagctatttttacatagcttttgtatcgtatagaaaatgggcagactaatcctattttttctgatttgaaatatttgatttcaaacggtcaaaataagattagttaatcattgtccacccatcgtcccttcgtatttgttacaaacagtgtagcacacacttacctgtaaaagcaaaaggtataagcctttttattccaggtttgaggcttcccactcttcttctaaaacggcataataatattcatcccaccagtcattatcatgggggatgcattttttgaaaaagccttcccgccgcattccgatcttttccatcacccgatgcgaggcagtgttttccggttggcatgtcgcaatgatccggtgtaatttcatcgttttaaacccgaatcccagcaaggcgcttgcagcctctgaagcatatcctttgccctgataatcagggtgaaacacccatccgatttcatacgtatggtcaccaaaatacttaaaaaaagcaatgtggccaatgaccgttttttcatccttcaatacaacagggaacatctcggcatgttcaccgctgttatcaataacgaatttcttggcatcttcttcggtaaagacaccctccggtatatacttcatgacattcagatttgaggtgtactcatagacatctttccaatcttccggttcaaatgtccggatcacgagcctgtcggttttgatattcatattatgttctcccatcaaaaaagatttcatttattacttcaatcaaaaagtgtaaaaacctttgagaggggaagggacgaatataaaaaagcctgcagatatacactgcaggcggttatttctcattcgcggcggcgggcaggtttgtaaagccgaattgccctccgacagcttcttttacttcatgaataacgataaatgatttcggatcaattttttgaacatgttttttgattttcagtaattcgttctttttaatgacgacatatataatgcgcttgtctttgctgccgtaatacccgtatccgtaaaaaatcgttgccgcgttgccgtatacggaggtgatcgctttggcgatttcttcgtattggtcagacataatggtgagggcttttttattatggaaaccctcaatgacaatatcgacgattttggcgcacagataaacgaatataaacgtatacagcgtatgattgatgccgatcgctaaaacggatgcgacaataatgacacaatccatataaaacatgcttttggagatgttaaaaccctttgtgtaatttaataaatacgctaaaagcgtggtcccgccggtagatccgtcagcgataaagattaaagccagccccgctcccatcagcagagcgccgaacacgatcccgagcaccatgtcatgaaccccgaacggaataaagctgacgatgctgagaaaaacagaagtcatccccgtaccgagtatcgtgtataaaatcgtttttttcgttagaaatttataagccagtccgataaaaatcaaatttacaaccagtgttgtaatactcgcaggtatatggaaaagataatataaaacaagagcgattcccacggtgctgccgtcccctaagtgattcgggatgacgaaaaattccacggacgccgcgataagaaaggccccggccataatcatcagtatatccttgcaaatgttcttcatgtgtagacctcctttgcagtcaaaaatatataaaaaacaaaaacgcctcaaaaattatccagcagaactaaataatttttaagacgaatcattcacaatctcgtttgttcattcagtaaagaatgatcagcttcaatatcgaagattatatagacaccttcacatcttgtcaatgctgtgaaaattgatttttctattatgtaaatgaggtttgaatcaaataaaaaagaggaattatatcagaagagttttcatttctgctctatcattaagagaaatgtatggaagacatcaaagaagggatgatgacattggaacgaatttttatcagtccggccaaatatgtgcaaggaaaaaacgcaattgaaacaatcggcggacatctggagggcgttggtgaaaaagccgtcgtcattgccgacaaaaccgtatgggatatcgctggtcacaaagtgacggctgaattaaagaaaagcaatatctcctctgaagaggcggttttcaacggagaagcttcccaggaagaaatgaaaagaattgcgggcattgcagaaaaagcgggtgcgtccattgtgatcggagtcggcggcggtaaaacgcttgatacggccaaagccgtatcagatgaaataaacggctacacggttatcgtgccgacggccgcttcaacggatgctccgacaagcggactgtctgtcgtttattcagaacaaggcgcgtttgaaaactatcgtttctaccataagaatcctgacctggttctggtcgatacgaaaatcgtcgcggaagccccgccgcgttttttagcatcaggtattgccgatgcgatggcgacgtgggtagaggcgcgcagtgtcatcgccaatggcggtaaaacgatggcgggcggaattcctacaatcgcaggagaagccatcgcggaaaaatgtgaagaagtactattcaaatatggccatctcgcctatgaatccgtaaaagcgaaagtcgtcactcctccattggaagcggtggttgaagccaatacacttctgagcggactgggatttgaaagcggcggcttggctgcggcgcatgccattcacaacggcttcaccgcgcttgaaggtgagatccatcacttgactcacggtgaaaaagtggcattcggcacgctcgttcaactggcgctggaaaaacgttcgcttgaagaaattgagcggtatatcgcgttttatatcagcttggggctgcctgtcacacttgaagacatcaaattgaaagacgcatctaaagaggacattatgaaagtggcagaagccgcaaccattgaagaagaaacgatacatgccgcttttgatgtcacggctgatgacgtggcagatgccattatagcggccgaccaatacgcaaaagcgtttaaagaaaagcatgcgtaaaacgtttcaccgcaagatcggagaccaagggctgttatggcccttggtttttttatgtcttcctgccgcccttgaaaactttaaaaaataaagaaaaaattatgatacaatatacaaatgttttgagagattgacaaaggaaaggtgggaacgatatgctgcataatccgaccggcaaggagcggcttgcgctggcttttcttctcggcatgcttgcgatactggggcctctgaatatagatatgtatctgccgagtttccctgaaatcgccgaagatttaagcgcccgcgcttcgcttgtccagctcagtttaaccgcatgtctgatcggcttgacaatcggacaggttgttgtcggcccgttaagtgacgcgcagggaagaagaaaaccgttattactatgtatttttttatttgccttgttttctctgttttgcgcgcttgcgccgaacattacaacattagtgattgcccgttttcttcaagggttcaccgcttcggcaggactcgttctgtcccgtgcgatcgtcagagatgtctttacggggagagagctttctaaatttttctcgctgttaatggtcattaccgccgtcgcgccgatggtggcgccaatgacgggaggcgcgattttactgctcccgtttgcatcatggcatacgatttttctctttttaaccgttatcgggtttttgcttgttctcatcattgcgctcaagctgaaagaaaccctgccgccagaaaagcgtatcccgagctctatcggaaattccgtgcggacaatgggaagcctgctgaaagatcggtcatttatcggctatgcgttgacggtcggttttatccacggcgggagctttgcgtatgtctcggggacgccttttgtgtatcaggatatttacggagtatcgcctcaggtctttagtgttttattcggcataaacgggctggcgatcattacaggaagctttatcatcgggcgtttcggcggaatcattcatgaaaaaagcctgctgaggattggtgtcattacagcgatgacggcgacagccgttctgcttgtcatgacgatcattcacgggccgctggcggcactggtgatttccatttttatttatatgattacgatcggcatgacgctgacaagcacctttacactggcgatggaaaagcagggacaccgcgcgggaagcgcaagcgcactgctcggcatgcttccgcttcttctcggttccatcgtgtcgccgcttgtgggaatgaatgaagcgacggccgtgccgatggggctgatcatgtttgcgacatccgttatcggttccatcgcttttttcaccttaacaacaaaacaggagaaagcaaaaaaggagtgaaatgattcactcctttttttatgcccgctattcatatttcttcaggatgatcgctgagttatgtccgccaaagccgaatgaattggagaggccgattgttaaagattgctgacgcggaccgtctgatacatagtccaaatcacacgccgaatcaggggtttgcagattgatcgtcggcgggatgatgccgtgtctcaagctttctgtcagagcgatggcttcaactccgcctgccgcgccaagcatatggccgagcattgacttgtttgccgtgaccggaatgtcataggcaagctccccgaataatttcttgattgccaatgtttcagaaagatctccggctttagtgcttgtcgcatgggcgcttacgacatcaatgtcttccgctgaaaccttcgcctttttcaaagcgtttttcatcgccaagtatgcgcccgttccttcaggatgggtggctaccatgtgatacgcgtccgagcttgcgccgtagccgagcacctcacagaggatcggagcatttcggctgattgcgttatccaatgattctaatactacaatacccgcgccttcactcatgacaaaaccatcgcgatccgcgtcaaacggccggcttgccgcggcggggtcttcatttctcgctgacagcgcgtgggcattgccgaagctggctaatgacaggtttgtaatcgccgcctccgcaccccctgcaaacatgatatctgcgtcatcattccgaatggcgttaaatgcttccccgatcgacgtattgccgatagaacacgcggtgacgggagaaagtgagggaccgagcgcgcctaatctgatactgatttgagcggcggccgcatttgaaatcatcatagggacaaggctcgggctcacttttcgcgctccccgttcgtttaacgtacggacattgtcaatcaaggtcgtgatgccgccgattccggagccgacgtacacgccgaggcgttcacggtcaatttgctcgagctgaatcccggagctttccagcgcctgttccgctgcggctaaagcaaactggctgaaacggtcaagctttctcgcttcttttctgccccatctttcttctgcgtcgaaatcgcggacggtgccggctatttttgtcttggagccggagacatcaaacgaatctatgatagagattcctgattttccttccgtcaggtgtttccaaaatgtatgcacatcattgccgagaggtgaaatcactcccattccggtgatcacaactcttttcatggtcattcctccttcggtatgtatttattgtaactcgcaattatcctattacaagttgttgattatcctagtataataagtaccagggtaagaaaggagagggtcagaatgataccagaagcaagattgcaggctctttctgagtttttaaaaacgcagcgggccaaaatttctccgcagatggccgggctgccaatgggcacacggagaagaacgccgggcctcagaagagaagaagtcgcgcaattagccggcgtaagcaccacgtggtatacgtggctggagcagggcagagacattaaagtgtcagcagccgtattggacgccgtttccgatgcgcttcagctgaataaagatgagagaaattatttgtacgcgcttgccattgatgagggcgtgaagcagccgtttacagcggaggaagaagcggtcatcagcccgtccctttcaaaaatcctccaggagctccgttattgtcccaccattatctcggacaggcggtgccatatcgtagggtggaaccaggcggcggctcacgtgtttttggattttgaacaaattcctcctgaaaagcggaatctcatagagctattgttttccagaaaagaattaagaagtctagccgtgaactgggagcattttgtgaaagggttcatcgccattttcagaacgtattacggccagtatgtcgcggatacgtggtattctcagtttatagaagaaatggagcagacatattcagagtttcatacgctgtggaatgagagcgaagtcagctcggctcccgaagtattaattgagttccgccacgcgaaggcgggaaaaatggtttttaacctgacttcctttcaggttcagggcaacagtgacctgcgctgcagcgtgtatacgccggtagatcacaccgaaacggaggcaaagctgaaaaagctctgcgaaaaccggtaaagaacagaaaaaaacgggaggcggctgccttccgtttcagtttaaaataaaagcatcagaccggcgatggccggtgttaaaaagatggctgatttcagaatgactttcggcacgagattggtgaatttcgctccgacatacgcgccgcacatcgttccgatcagcactttgaccaacagcatataatcgacaaatccttccgtcacataaccgagtcctccgccgactgcaagcgggataatgacaagcatggtggtgccgaccgactggcggatggataagcgcaaaagaatcattaagccgatttggatgaagggggcagaaccgatgccgaacgttccggacaagatccctgcgatgataccgagcacaacggctttcacccatatgttcaggttgctttgccgtccggagtcttcttgtgtttcttttaaaataaataaccggaccaaaataagcagagcagataaaaacagcatgcccgccgtcaagtaatgcagcaaatctgcgggaataagagaagtaagtctggctccgaaaaacgaaccgaatgccgcaaaaacgccgacgatgagaccgattttcatctgaatattgccttcacggtagtggctgaaagcccccgataaacttgtgaaagccattccggcaagggaagtgcccaaagccgtatgaattggtacgtgaaaaagtatggttaaaagcgcaatgacaaaaccggctccccccgcgccgataaacccgagaataatcccgagaagaaacataacgagtataataagcacaatcttctcctccatttagatgcctgatcacaatattccgatccgctgtatcaggttttaacaatcgacattggtcgtccgtcgaccgtcgttcaatacttttatgttacctcaaatttaaggtattggcaagaagacgaatggcttttatacagagagtctacagctctttgaccatcactttttccccgttgaagtccagctctccattgaatataaagctgaatctttgataaaggcgcaatgcgtgcacgttatcttcaaacagacttaaataaatccgtctgcaatcatataatcgagcgaggtgccggataagggcatcaagcatcagtttgcccaaaccgcgtccctgatatcgttcatcaatgaaaaaacggtcaagccacactctgccgttttggttttcctcatcatattccggaaaccatccgtacatggcaaagccgaccaattctccgttaaaataaaggccggccggctgataatgccggcaatcctcagcatcttgtaaacacttttccacggtttcaataaatgaagtctggctttcgcttacatgaagcgccagtatatcagcacggttttcttccgtgactgctttgatttcaatagtcatacttaatactcctcttccgctttttctgagacggttaaaagcttcgattgccgtaagcgtccgtccataggtaagctgatttgtgagtcagccttctctcagatacaatgaacatcataaaggatatggttaccgtatagtcaaggaggtattatgagcgaagacgtcagaaaatactttacaacgggtgaatttgcaaaactctgccacgtaaaaaaacaaaccctgttccattatgacgagatcggcctgctctctccggaaatcaaaaaagcgaacggatacagatattattcctatcatcaattcgagctgtttcaggtcatcagtctgtttaaggaggtcggcatacccttaaagcgtatcaaaccgctcttaacagacaaaacccccgaggatatcatcgcgcttttaaaggagaaatcctcagaaatcgaaagcaaaatcaaaaagctcgaacacctgcaaaggatgattcagacaaaggtgaaactgaccgaacaggccttggagacggacttttcctccgtctctctgcagcactcagatgaagaaccgcttatgatcgggcgtcctgtactcaatttgcctgaacggcaatacaccgccgctctttccgaattgatccgctataggcaaatccatgaactcgatcaggggcacccggtcggcggcctgtttgcgcgggagcagattctgaagaaagaattctacaactacactcatttttatatcaagacagaagaaggcatagtgaataaagacctccatatcaagccgaaagggctttatgcggtcgggtatcaaataggagatgaagcggaagcggcttaccgcagaatcatgcagttcattgaagagtatgggctggaaatgggggattatgcatatgaagaatacatgctcgatgaagttgtggcggatgggtttgacaatcaaatcacaagaattcagctgcaagtccgcggcacataaagctgatcatttacgccttttaacaaaccttgtataatgagaaaaatcagattggaaattgaggtgaaaagcgatatgtttttggcgcctttatttgaacatgatgtaccggcagcacttctccgcccttaatggaggaaagtgactgcgcttctctccgttagggcatgtcacatgacctaatatgataacggagggtgcatcaaattgaaaaatacgttgttcggttcgatttatttggcattggccgccagtatctggggcggtatgtatgtcgttgtaaaagttgtggtagcggtcattccgccgcttgaactggtatggctgagatatgcggtcgcgcttgtggcgcttttacttctcagtttgtttacacgtcaatcctggaaagttcataaacgtgatctattactgattgctgtgatcgggttgatcggcaacacgatttcgatcgtcacgcaggagatcggcacgaaattatcaaccgcgcaaatgggagcgatcattacggcatccactcccgcatttatggttgtatttgcccgtctgattctgaaagaacggttaacgctgaaaaaaggaatatcggtaggactggcgaccatcggggtattgctcatcgtagggaacggagatatcaatatgtcgggccagctcggcggtctctcgcttctggctgcggcgctgacatgggctttgatgtccgtgctgattaaacgggttcccggccgttactcaccgcttgtcgtcacaacctattccatttgtgtcgcatttgtcatcctgaccccgtttacagcgggcccgcttcaggagattccgttgtctcagcttgcccggcctgagatatggggcggccttttatatctgggtgtgatttcaacggcctgtgcgttcatgctgtggaatcgcggattgcaattgctgaatgcggcaagcggaggtctgtttttcttctttcagccgctctccgggacattgctcggctggctgctgctgggggagaagatcggaggaaccttctggatcggggcggctcttattgctgcaggcgtcgtgctcgttattaaagaaaaatagtgtctgaaaaaaagccattcattgcagaatggcttttttctgatgtaatggcaggattcgtcccgccatgcacagaaaaaaagaagcagaaacggatcatgagcacggtactcttaaagtcaatacccgggtcctcgggagtccgtcaatcaaagtaaggcggtgaaaataatggagccaaaatggcttgaatgggcaaaacagcttcaatccgcggcgcaagcggggctggcatattccaaagacatatatgatattgagaggtttgaagaaataagaaaaataagcgtggatatcatggcgcattataccggcatcgagaaacggatcataaaagacgtattcgccggtgatacgggctatcccactccgaaagtcgatatcagagcggcagtttttaaagatcagagcatattaatggtgaaagagaaaagcgacggcaaatgggcgctgccgggcggatgggctgatatcggaatctctcctggcgaagccgctgtcaaagaagtaaaagaagaatcgggaatcgacgtaaagccggtgaaattattagctgtcatggataagaaatgccattcccatccgccatccgccgcccacgtttacaaagtgtttatcaaatgtgagatcatcggcggacagctcagggagggaacggaaaccagcgcggccgctttttttgcggaaacggagctgccgccgctatctgccgcccgcaatacagaaagtcagattgaaaggatgtttgcatatctcaagcatccggatgagcccgtttattttgattgaggctgccagcaggaaaaagagggggctggttcagaaccatttcacttatgaatgatccggcctgtgatagagaagataaatcctcaggccgggttttaagagtgtgcctgtttcggtgtggtgcgccccttaaaaaaccgtttttgaaaaatcaataatcctgcgggcagtttctgtcggtttttcctcggggacataatggccgcagccttttacctcatatccgctgacttcacgtattgattctctccatgtgtcaagcacgggaagaccggctaaattccctttttctccccacagcaaaagtgtgggaacctccagttttttttgtgattccttttctgaacgatatctcggcaaatcaatttgataagcggctctgtagtcattaagcgcagcctggacagcgccgggctgcttccaggcggctaagtaccggtcccaggcgccgtctgatgtcagcaggtcaaaaagcccgtcacctctgcttaataaaaatctaagatattcctcttcttttccttttattaattcttccggcagatggggaacgacttgaaatgtccagtgccagtatttttttgccgcttcagctgccgtcagagaatcatagacgtattcagtcggcataatgtcaatgagcacaaggcctgccgccagctccggagcatctaaagccagccgccttgctacccttgcgcctctgtcatgcccggcaattaacgctctttgtatacgcaggcggcgcatcagaccttgtatatcgcttgccatcgatttgttatcataaccgtttatgccgctcggcttttcagaatcgccgtagcccctcagatcaacagcgatgactctatgagaagcggcaagcgtcggaattacataacgccacgtcacccagctttgcggaaagccgtgcaggaggatgacggggggagcatcctcctttcccgcaaagacataatgaaggctgatgccatttacctcaactgaatcatgggtcacatgcttttcaaattgttcacgaaaagaatccattttctctctcctcataaaattttatttttttatttgagaaataatagcggaggtgacgtcttccgttgaatgctttccgccgacatcaggggtcaggacgccgctgtttgtgacggtttcaattgattgtaagaggagattgcccagttcctcttctccgaatgaatcgagcattaattttgccgtccatatttgccctataggattggcaattcctttcccgacaatatccggagcggagccgtgaacaggctcaaacatagaaggatattttccgtttacattgatattggccgcaggagcgattccgacgcttcccataatcgccgcgccgatatctgtcagcacatctccgaacagatttgaagcgacaatgacatcaaagcgttccggatgagtgacaaaaaaggccgccagtgcatcgatgtgctgcgaatctgtcttaatcccggcgtaatcccggctgacctctttaaagatgtcgtcccagaacggcatagagtgtacaataccgttagatttcgtcgcgcttgtgacgtgtttccgccgatttgccgccagttcaaaggcataccgcatcactctttccgttcctctgcgggaaaagaccgcgttttgaatggcgatttcgtcttcatcctgatagattctgccgccgacagagctgtattcgccctcactgttttcgcggacgactaacagatcaaaatccttcgggttcacgagaggggaggtgattcccggcagcagcttggccggccgtacattaatcacctgttcaaattcccggcgtatcttgatgagcagcccccacagcgaaacatggtcggggacgagtttttgatttcccaccgctcccaaaaacaaagcatcaaagtgttgtaacgtttctaatccatcatccggcatcatggttccgtgctccagataatactcgcagctccacggaaaagaagtaaaatcaaatgcaatgcccccatgtaattcggcgatcgcattcaatacccgctccgcttgcaggactacttcttttcccacgccgtctcccggtatgctggcaatcttgtatgttttcatgtttccatcacctctgaatgaattgtttcggtttacggaagaccgtcgaccgtcgtttgtaataattccatattacgccacttttgctgggctgacaagcttgggaatgttgcttccatagataaactgttatatgatcttggtaacataaggcctaaattgtatgaagaggtaggaaagatggataattttaaattagataagccaaccccgtattatctgcaattttattctcaattgaaaaaaatgatattcgacggggtgtttaaaccgggagaacggctgaatgaaacacagctggccaaggattttggagtcagccgatcaccgatcagagaagccatgcggctccttgaaaaggacgggctgctgacggcagacgatcgaaacggctttgtcatctattcgctgtccattaaggatgtcgaagagatttacaaaatcagaatatcgcttgaatcactggcggtcgaactcgtcattgatgaagcggctgagagcgaaattgaacgtattgaacagcagctacgggagacggaagaagccattcataaaggcgccaaagagactgagattatttccttgaacgaaacgtttcatcagctccttgtggatttcagccgcaacagccagctggccaagctgcttgagcatgtcaatgtgctgattcatttttgcagagttcttaattttaaaggagatgaccgtgcggaggttatcctgcatgagcaccggaaagtctttgaagaaataaaaaaaggcgacaaagcaaaagccgtgcaatatatgaccgagcatctccagcatgatgtagaacatctgaaaggcgtgctgaaagcggaagaaacagacgaatcgtcacgattgacaaggtgaaaagccttgtctttttttgttggtgtcattaaatcgccataaagacccgacggatgttccttgcatgatttttttcgcatcatttatgatggatatggaaaaagggcgaaaaggcaaaggagtttgaaaaaatggctaaacatattctaatgatcaattttcccgcagaaggacacgtaaatccgactctgggtgtgacaaaggccttcagtgaacggggcgatcacgttcattatatctcaacggaaaaatacaaaagcaggctggaaggagtaggggcggaggtccatcttcaccgcgatctgctcagaatgacacccattgatcccggcaccccggccggtatacttgcatttttaaaggttcatatcaaaacgtcactggagattttacagattgtgcagcgtctggctgaggacattcaattcgacgccgtctattatgataaattcggtgcgggagagctggtgagagattatctcaacatccccggcatctcttcttcagcatccttcctgttcaatgaagaccgtctgaaaatactgccgctccatccggaatcaggcgtgccgtttaagccggacagggaatgtgaagagctgttggccgagatgaaagacaaatacggcgttgctcctgacagcctggttcagtttatgaacaacacgggtgaactgaacgtcgtctatacaagcagatattttcagcccgaaagcgagacattcggagatgagtatttatttatcggtccgagttttccgaagagaaaaggggacaccgccttcccgattgactctttaaagaatgaaaaagtcatttatatctcaatgggaacggtgctcgggaacacggaagcgttttttaatctgtgcatagacgcgttctcagattttgaaggcaaggttgtcattgccgccggggaaaaagccgatctgtcgaaaatcaaacaggcgcccgaaaactttatcatcgctccatacgtgccgcagcttgaagtgctggagcaggcagacgtgtttgttacacatggcggaatgaacagtgtaaatgaaggcattcattatcaagtgccgctggtcgtcatcccgcacgataaagatcagccgatggttgcgggccggctgactgaattgaatgcgggctttacagtgcaaaaagatgaagtaagcgctgaaaagttaaagcttgccgcagaagaagtccttcacaacgggaaatacaaacaaggcattcaagccatcaatgaaagctttaaagaatgcatggacatgaaggatgttctggcacggatcgaccggtttattgaaacgaaaaatgctcattaaaatgaaaaaaagcctgtttccgcctccaaaggggaaacaggctttttataatggctttcagatgatatgatgctcttcatttgcaagtttcaccgccggtttggcggatgagccaattcatattttgttcatattttattaaaagtttatccaagcctgtcctttacagtgaatataatcacaaatacgctgctgaaaggggcttttaaaaatgcatattcatatgatcaacaaaaaccagtttgagagtgacttggaggcggccgggttcagccgtcaggcagatgatattatcgggaaaatgaaagagtacgtaatggaatatgcggcttcatccgaacggttcctgattgaaacacaaaccgtcatgaacgaatacaaagctgtcgtctgtgcgatgttttcaaccatggaaattgccggggcaaagaaagacgagaagcatgttgaattcgaagcctgcactgtatggtgtgaataaaagaatcacattaaaaaggaaaaatattgaaacctataaagcaggtatccgtataaaagagagaatcagtttttagaagggaggacgcgaatgaacgataagaaaaaacaagcttttgaacagcttttcagcacattagacggaagacatgaaataaacggagctgtattagcagcagaaaacggccgcattttatatcagggttcattcggaactgcagaactggaaacaaacaggatgctgaatgaccaatcggtctttgaattggcttcagtatcgaagccgtttacagctctgggtgtcatcattttagagcaagaagggaagttgcgctatgacgatatgatagagcggtggcttcctgattttccttacccgggcattaccattcggcatttacttcatcatacgtcagggttgccggactatatagagttgttcttaaaacattgggatcggaacaaaattgccgttaatcaagatgttatgaatatgctcaaacggcataagccggatgtttatttcccgccgaataaaggctggctttacagtaatacggggtatgttgtgttagcggttattattgaaattgtatcaggcatgagttttgctgaatttatgaaacaagccgtatttcatccccttcgtatgcacgatacgcggatttataacagaagattgagcaaagaaaccattccgaactatgcatatggctatgtctatgatgttcattccggagagtatgtgctgccggatgaacttgaggaaaccgattatgtcgtctttcttgacgggattcaaggcgacggaaccgttaactctgccataaaggatttatatctgtttgatcaggctctttatacggaagaaattatcagcaaggaatctaaagatcaagcgtttacacccggctattggaatgaagaagagcaattcggatatggttttggctggatgatccgaaacagcagcgaaaaagggaagatgatcagccacgacggaggctggccgggatattccagtctgatgcttcgatatattgatcagaataaaactctgatttatctcagcaacatggaacaatcggatcaatttgaacaagttgtgatcgaagcggcggtaaacatcttatttgatcagccatatgtgattccgaaacgtccggcggatcagaaaaaagcagacatcgaccccgccgtttacagcagatttatcggtaattattcatttcaggatggtacctatgcagcggtgacggtaagagaaaaccgattgtatattacaatagacggacaaacaccattcgaattattcccaatgacagaaacccgttattttgtcagggcgctgccgattgaaattgaatttgcaggtgataaagcacaaacagcctcacatttcgttttatatcaggacgccacagaagaaacagctctgcgaatagactgagtgacatacagaaaaaccgccgtcctgagaagacggcggtaacagaaaagtcaaacccctttgattatgcgaaattttattttcggctctgacataaatatagaagaaaaaatcatagctccgagcattgtgatgtattccatataaagtgaaacctctgccaaaagcaaacccgcaatcattaaaacagcgcccaataccaccgcaaaaaccttcgttttcatgatgagttccccctattatctgataattgaattatactgcatttctattaatgtgtacattttgtgaacaatttcacctgacgaaaggcaataaagagagatttgaagaattaggagaaatgacaggccgcaattcatcttttgttttactgaggaaccgaaagggaaacgcaaaactatcaaaaaagcaaaggagttaattgaaatgaaagcgcgactatttttattcagcatgtttctcctgattcccgttctggcgcttgccggatgcaacagccaatcttcaggaggaagcgaaaaagcgaaagacaaagaaacgcactcacacgaagacatgaatcactcaggttcatctgaggtgccgaagggtttaaagaaggccgaaaatccgacttataaagtgggcagtgacgtcatgattttagcttctcatatgaaaggcatgaaaaatgcgcaagggaccgtaaaaggtgcttatgatacaacggtttacagtgtatcttacactccggaaaccggaggaaagcgcgttgaagatcataaatgggtcatccaggaagaattgaagggcgctggcgataaaacgttaaatccgggtgacaaggcagtcatcgaggcagcccatatgaaaggcatgaagggtgctgaagccgtcattgattcagccaaaaagacaaccgtttacatggtcgactatacaccaactgatgggggcaaaaaagtaaccaaccataaatgggtgacagaagacgagcttactgccgcaaaataaaaaagaacgcaaaagccgaaggaattcctttggcttttttgcggtctcacacttatgcggattttcttttcaaagcgggtctcgttaaagagaatacggctaagctgactgcgataatgacaatcaaaccgccgcaccaggcggttgctgtgacagaacccgtttgtccgatcacgccgccgccgatggctgacccgagcgcaatgccgatttgcaaagcggacgtattgaagctttgctgaatatcggaagactcaggcgcgattttgatcaaatagctttgctgcgccggcgcaaggctccagctgagcaatccccaaatgaccatcgcaggcaggaaaacgattaaagaaaccgttgacagcggaaggataaacaggatcaaagcgaaagaaacggtcacaagcatgatgcttttaaatgatcctaaacggtcatacagccagcctccgaacgggccgccgcataccgctgacaggccgaacaaaaagtagcatacactgacccaaacagaactcaaatgaagcgttgtttccaaaaaaggcgcaaagtaggcatatagtgtgtaatgccccgccaatgtaaataaggtaacaagatgcgcgctggcaatcttggcgttcccaatcgttttaatctgctcacggaacgggatcattttttcagcaggtattttttcaaaaaagacgctgataatcagcatggaaaccagagataatacgccgattcccaaaaacagcacgcgccatccgaaggcattgctgatgataatgccgacaggcacgcctaaagcgattgcggagctgaagcccatgaaaatgatgccgatcgcccgcgctctgtattccggcgccacgattttaggagcaatcgttaaagaaaggacgacaatcagccctgtgctcatggaagcgagcactcgtgacaccataagtacggcgaaattgggactgaagtaagcgaccagattactcaggaagaaaacaaaaagtgcgattaaataaagccgctttcgttcagcttttgccgtcactgccaaaagcagagggcctgataccgcgtaaccgagcgcgaacacgctgatcagctgcccggcgctgacgatcgatatgtctaagtcggaagcgatttgcgggagaataccgcccacaattaattcaaccaatccgactgcaatagtagatgctgcaagcagaaatactttgaaattcatgtacagatactcctttttttattttttagaaaataaaaaatcctgattacaaaaagtgtgcgggacagttttttgtaatcaggattttacggttcctggtagacaccctcaaaccatatcattgaggttatacaatgtatgcaatattcgtttgtgtccgtttctgcaaaaaattctaccataatagtgagagagattccatagaaaattcgaggaaatcctttcaattttaataacggcggctgtaacgtcattgatgaagcagggaaaaaaatttatgataaccgtaaggagtctatacagatcaaacattacacagccggaggaaaccgatgaataagtacgaaaaaatcgccaacgaaatgagaacgaggattaaaagcagtgtttatgacatagatcagccgatcccggatgaaaagacgctcgcactggaattcgggtgcagccgaatgacgatgaaacgggcgctcgacacgcttgcggctgaagggatgcttttcagaaaaagagggcacggcacgtttattattcaatcagccatgcaggacgagcacgttcacgtagtcagcaacgaaattctcggcttgagcaatttgttaaaaggcaaagacgtcaaaagcaaggtcatccggtttgaagtgcagttcccgtctcaagatgtcgccgcgcatttggccatcgacgaaaagactcccgtctattatgtagtgaggctgagaatcgtcgaaggcgaaccgtacgttcttgaaaaaacgtacatgccggcgagccttatacccggcattaacgacgaggtgctcaaccattccatctacgatcatattacgcaagagctgcagctcaaaatcgcaggcacacacagaaaaatcagagcgtgcaagtcggatgatatggatcagcaatatctcggctgccgggcggatgacccgatactggaagtcgagcatgtaggctttttggataacggcaccccctttgaatattcattttcccgccaccgccatgacaagtttgtcgtgacctcagttaatataaaacgttcgtaaaagcgccgaagagtgagagaaaaaactcactctttttttcgttgcgcctgatttacaccttcgccgattttatgttatattatccaatgatagaatcatcctacaaattacagaggtgttttgatggatatatccaaaacaagcagactgtcgctcgtagaacaagtggtggcgcaaattgaatcgttaattcaatcggataaatggccggtcgggacgcgcattccccctgaactggatttaatgaagcaatttgatgtgagccgaaacacgctgcgtgaggccatccgggcgctcgtacatgccggcctgcttcagacaaggcaggggagcggtacgtatgtcagctcatccagtgtcctcggcgcggcattttaccgtcacataaaaaaatcaaatttgcttgaaacattagaagtcagatacgcacttgaaagagaagccgcacgattggcggcccaaaggcgtactgatgaagacttggaggcactgaaggcatgtctggatgaatgtgaagcggccttgcaaaacgacgatcgaaaacggtatgccgaagccgacattaagctgcacaaaacaattgtacaggcggcccataacaatatgctttctgatctatacgaacatatgacggaggcgctttgtgcgtcagtccataacctgttggaaatcacccctgatatcagggtccacagccagcttgccgatgcgattgccggacagaaaccggatcaggccatggaggctgtcaatcaatacatcacaggatttaaagatacaatacacatggaggataaacatgaaaattgaagacgaacatcaaatgttacaagcaagtcagcgtaagaaactgatcttgctgatcatcggagtcatattgataggggccaatctcagagcgcctctgacatcggtcggaccgctggtttcctcaattcgggacagcctcggaatgaccaatgcggctgccggcaccattaccacagtgccgctcttggcctttgcatgtctgtcgccgtttgttcctttattgtcccggcgcttcggaaccgaacttgtcttactgtcatcattaattatcctgacagccggtatcctgctgcgctcaatcgccgggatcggcactctctttttagggacgatcctgctgggattatcgattgccgtatgcaacgtactgctgccgagtctcattaaacataagtttccgggaaatttaggcgttatgaccggcgtctactcggtttctatgaatctatgcggcgcgattgcatccggcatcagcgtaccgatcgcctcctcagctggattgggctggaaaggcgcgctcggctgctggggcattctttctttaatagcgttcgtcatgtggattccgcaaatgaggggacgcgaactgcccgtccgcacgccgggggcagacggagggaagaaaagcagtctgctgcggtccccgctggcttggaaggtgacgatgtttatgggcctgcaatcccttattttttacacagtcatcgcttggctgccggaaattcttcagcagaatggactcagctcaagcagggcgggatggatgctttcgttaatgcagttctcactcctgccgattacctttatcgtgccgatcgctgccgctaaaatgaaaaatcagcgcgctctcgccggactgacggccttatttttcttcatcggcattgccggtgttctttgcgggagcccgtctcttactccgctatgggtcattttgatcggaattgcgggaggctgtgcgttcagtctggcgatgatgtttttcagcctgcggacccggcatgttcatgaagccgcggcgctttccggcatggctcagtcattcggatacctgcttgccgccttcggaccgctcgtattcggcctgctgcatgacatcacgcacggctggacggttccgttattcatgctgatcgcagtctccgttctgatctttattttcggagtcggagcgggaaaagcagaacagatcaaaacagcataaaaaaacaaaggacccgagacgggtcctttgttttttatctgaaaagcagtctccggccatcatgtcgtcagttttaaaccgatgacaccgatgaggataagccccagagacaccaattgtgacagattgaatttttctttaaaccagagtatgcccacggccgaaacgccgatgcttcccatgccggtccaagctgcatacgcaacacctgtgggaaggacctgcatcgcttcagaaaggcaaaagaatgaaagcataaagcctgttgtcatgacaatcagcggccacttttttttaaagccgtcaatatgtttcatggcaacggccgctacaacttcttccgctccggcaataaataacagcagccaagccattaatgttcactccttgttttattttctttcgtaaataccttcattcctaaaatgccggacagcagcaaagccaaaaagaatatctgcccgattgaaaaaggttctcctaaaataacgcccgttacatatgtgccgaccgtgcctattccgacaaaaacggtatatgcggcagccatggggatttttttataagagcggatcaacatcagaaagctgacggcaatcagaaggaaaataccaatccaatcaatgagcgaatccgcatgcttcagggcagacgcccaaatcacttctaacagtccggctatcagtacaagcagccaatacatttacagtcacctcaattatgaatgaatgtcagtcatttttatggcggtcaaaaatgatcggtctctgccaatcatttctgcaagcttcttttaagaaagctgaatatttcttttttatacacttcgagatcgacatcctgttcacagccgatataaaatcgttcagccgcgttctcgacaacgttgataatcgttctggccgtccatctgacatgaatgccgctgatgaccacattctgctcaatggccgtattgatcacgtcttccagccaggaataataaggctgataaatggcctcccatttttccattgagtgatcgatggcaagaccggaataacagaggacgataatatctttatgaagccgggtgatgtgaaatgtctcatcaaccaaaatgtccagcaccgtccaaaaatcttcagtgccgtcggttttccctttaattctgtccagcgtaaggtcgagcaggttttctgcaatcgctgatatcagtgcgtttttagaagaaaaatataagtaaaacgtaccttgggccgttccggcttttttaacgatttctgaaatggatgctttgtctaatcctttttcagaaatgacttcaatcgcggcttgcaggatcttttcatattttcccgagctttgttttgccaatagaggggttcctcctttatgaatgactgtcattcattttatcatatgattgtttttttgtcatccttaacaataaaaataccggaaagaagatcgtgcttctttccggcattcgtcatttatcactgtcgattatagccttcggcagccctgtatattttgcccagtaataaatgccgagcgaaccgatggcgatcagaatcaggtcaagcggattgctgataatgcccaatccatggccgaacgagccgatataggagaaaatcagcatcatgacataaaaaccgacgatccaccaggctgatttcagctgctgccgtatgctgacatcatctttaggggcatatttactgaaacagaggtagacgagaaacatgacaatttgagaaccgagaagccaggaaacagtgcgccagccggaccaatatacaatataagaagtaaaaataaacgacagcggtccgatgatgctcataccctttaaataaaacggtctgttaatatccttcgcgtttaccctcagcgccgctgaagaaatcggcgcaatcgcataagacagaatcaatgcgacggagcatacgttgacgagagcgttccaggaagggaacggcagcgtccaaaaaacagccagaccgaacgagagccaaagagaggcacgcggtgttccggtttctttattgactttagaaaagatgctgaataatgttccgtttctggcccaggcatagacgagacgtgaagtcgtattcataaagatatttccgttgccgcccggtgataaaatcgcatctaaaataaccaatgtcgccagccaccctaaaccgagtaaaacggcgatatctttgaacggaagggagaattcctgcccgatagccggccatccgtgcttcagtgtgtctcccggaatcgccccgataaaagtgatctgcagcacggtgtaaattatggtagaaacaataatacagacaattaatgcgatcggaatgttgcgcttcggattctgcacttcactggcgacagctacaatagggtgcagcccgaggtaggcaaacatgacaccgcctgtggaaatcgccgcctgaataccggtgaaaccaaaaggcgcaaatccgtgaacggtcatattgcccgggtgaaaatgaaaaatcagtaccacaataaccgtaatcggaacgacgtatttaaaaatcgaaataatgaagtttgctttcgcaaaggttttgacactccagtaattgaggaggaagaacaggcagagcagcgcaaattgcaatatccacccggcaattgtcggcgaatcggagccttttacggtcaaaccgggaaaccaatacgccacgtattggcggactgccgtgacttctatagaaataaggctcgtgtatgccacaatggtgacaaaggaaattaaatatccgacgagatgtccatgtgaataaacgggataccggataattcctccggtccgcggcagagcggcgcccagttccgcgtaaaccaagccgatcaataagataatccccccgccgatcagccaggaaaaagcccctgatggacccgctttagaggcgacgttactgacggcaaacagccatgccgaaccgaatatggctcccatgccgattaaaataagatcaaatagtgatatggatttctggaagtttccttgcttagacattcgctgcctccttaaaaagacattgttctatttacataattcccattatcattcgaacatacccagccggccggctggaaaattaggacaactttcgagttgatggtatgtacagcaatgtgctcaaattataatggagtgacttgaaaaacggccgtatctcaagatctccccgcatatattccctgttttgaccgcgttcaaacctcattcccataaaaattaaaaaaacgcccgaacgaagcaggcgttttttattacaagttcatatctttcagtcctgggctgtgctcattcggaagctccggaagctcaggcacaggaaaacctttaggcggttcggacacacttaattcgccgccgtttcggctcggcgtcgttccctgcagaatttctccgatccgtgtcgggtccagcctgaaattaaattgggtattatgataacccatctcaacgaatttccggcattccggatatttttcaatatcataattcggcacggggaataatttcccccattcaacacccagagtttccagcgcttttgtaaaagcattttgatgggcgttgtcacggacaatcaggaaaccgagtgtttctctgaacgtctgatttgaactcatttcataaatgcgcgttttttgcagaacgccggttgattccagcacaacattgtccaataagtcggcaatcagattaccgtgattgtagacccaagagccattccatgggttgccgctggcatctgcaggcagggaactttgcgccccgataatataatggtgcggattggcatgcttcaccgcttcatcaatcggcgcctgatctgctgcctgatttccggcaccctcagcgccgctttcgtcgagcagcgcattaatcgtattctggacgagctcaacgtgtgcaatttcttctaaaaatacaccgcgaagcaggtcgcggaactgcttttcttttcctctgaaattagagctttggaaaaagtattgcatcatcgtccgcatttccccgtaatgcccgcctaaaatttcctgaagcaccttggctgcggccgggtccggcttgtccggtttaatgatattgatcagctcttctttgtaataatacacaaacagcgccccctgaaataagttttcggttcttctgttagtgtctttgcaaagtcgatttttatgtatcggcagcaaacaaagggacggaaagcgtatcccgtccctttgttttaagcttcgaccgccccgcggagttttgtgttcacaagtccgttccatccttgatccattgtactgtgaatctcagagcttttccgattgactttattgatgacggcatccggttctttccatccgccgtgaatgagagtgaattccgtatctccgctttccgtttcttttaagacaaaagaaacgatccagccctccgtatcccacgaaaaagaaagacggtatggcgcctcgatatccaacagcttgcacggagatggaccgaatggggattccagctgaaactcactgtcttcctgaggcgtgaaatcattcggcataaaccagagggacagtccgtctgcagtggagaccgtatcccagacaacttgtatcggcgccttgaaaacggcggtatgaataatgtccggtaatgtttgattaccgctgttgctgtttttgttatcattgttttgtttatcagacatgctgtgtaaccactctttcgctgttttttcttttgatcatactacacagggcaggacatttgaaaacaaatcaaacttattttatgcttttccaaagcaattcaattcattttaagggagacgtagtgatgacagatcaatttaaagcgttagtagtcgatcaacgtgaagaccggttttcagtaagcgtacggcagctggctgttcaggaccttcccgagggcgaagtgctgattaaggtttgctattcaggcgtgaattataaagacagcttggccgccattccggacggcaagatcgtaacctcgtatcctttcgtaccgggaattgatttagcgggaatcgttgtttcctcagatgacgaccgattcaaagaaggggacaaagttattgcgacaagctacggcataggtgtttcccacttcggcggctatagcgggatggcccgcattccggcagattgggttgtgcctctgcctgatggtttgacacttaaagaagccatgacgatcggaaccgccggtttcacggctgcgttgtccgttcagcggcttgaagaaaaccatgccgcccctgaaaaagggaaggtcctggtgacgggagcaacaggcggtgtcggaagctttgcggtttccattctttcttccttaggttttgacgttgaggccagtacgggaaaagaagaagaaagcgcctatttgaaaagtctcggagcgaagacggttatttaccgtgacgaagtttataacggcacgttaaaaccgatgcaaaaacaaaaatgggcagcggccgtcgatccggtcggaggtgagccgcttgcgtcagttctcagtcagattcagtacggcggggcagtggcagtgagcggactgacagccggaacgaaactcccggctactgtattcccgtttatattgcgcggcgtcagtctcttgggaatcgattccgtattctgtccaatggaaataagaaagaaaacatggcagcgtttagctgatgatttcaagcctgcagatctggaggcctttattcaaaaggaaattacacttgaggagctgccggacacgcttcctgctctcttaaaaggagaagcgagaggaagaacgatcgttaaattgaatgaagaataaagcgaaaaccctcaacattagttgggggttttttcaatatataatcaattattggttaaaagtaaggttaaatattgagtaagttataaaagtaagctgattataaatatgaaatgattatatataggtcacatatagataaattataaaattttctgaaatatttattgactgaaagcgcttttaaaattatgataataacataagtgccaataatatcattataacttcactacaaagtaactataaaataacaatttgtcggaagggaagtgaatattaattataaatgataacgctttcatattgatttcttcattataggactgttttgggcggtcggagcatgtgtgcagacggtataggtgtaaatatcgataactgaatattcaggtattatctcagcataaaagctaggaggatttgaagatgaataaaaatagcagccagtattcatttttgaggaccatcattttagtatcgacgttcggaggacttcttttcggctacgatacaggtgtaattaatggagcgctgccgtttatggcggaacctgatcagcttaatcttacggctctgactgagggcatggtggcaagctccctgctcttgggcgctgcgatcggcgcggtttttggcgggcggctgtcggattataatggcagacgtaaaaatatccttatccttgccgttctgttctttgtggcgacgcttggatgtacgctggcgcctaatgtatcggttatgattatctctcgttttctgctggggcttgctgtcgggggagcgtccgtaacagttccggcatacttggctgaaatgtctccggcggaaagtcgcgggagaatggttacccaaaatgaactgatgattgtaacgggccagctgcttgcctttacgtgtaatgctattatcggcaatgtgctcggtgatacctctcatgcctggcgttacatgcttgttatcgcggcgcttccggcggtattcttgtttttcggtatgcttaaagttcctgagagtccgcgctggctggtttctaaaggaagaaaagaagatgctctgcgcgtactccggagaatacgcaatgaagaaaaagcaaagtctgagcttgctgagattgaatctgcttttcataaggaagcggagatggagcaggcgacatttaaggaccttgccgtcccgtgggtgcgccgcattgtgtttatcggaatcggaattgcggtagtgcagcagctcaccggcgtaaattcaattatgtactatggaactcaaattttaaaagatgccggcttcgaaacaaaggctgcattgatcggcaatatcgctaacggtgtgatttctgtgctcgcgacttttgtgggcatatggcttctcggcaaagtcggccgccgcccgatgctgatgacggggctgatcggaacgactgtcgtcctgctgctgatcgggattctgtctgtcatgctgaaaggatcgcctgcacttccttatgtgattctttcattaaccgtcactttccttgcgtttcagcagggagctgtctctccggtgacctggctgatgctgtcggagatattcccgcttcgattgcgggggctcggtatgggagtcactgtcttctgcctctggatcgtgaacttccttgtcggtttgactttcccggttctgctcgcaaacatcgggttgtctgcaaccttcttcatctttgtcctgttagggatagcgtccgtcatattcgtaaaaaggttcctgccggaaacaaaaggtctttcgctcgaacagcttgaacaaaatttccgcgcctatgaaaaaacagatcgaaaaaccgttgaagccgaggtgagcgggtaatcaggagagaagcagggtttttagggatcctgctttttcattcttttattatatagaaggaaataataagcgagaaaaaagttgtgtaaaagtgttgacgtgttttaaggggcgtggtatattattaaacgtcgctgatgaacaaagcggtaacgccaaatgagaaaatgtttttttgaaaaaagactttacaaattctcataagtgtgtataataaatgaggtcgagaaaaagacttcgaaacaaaatgaaaaaacgcttgacatcataactgattagtggtatgatagttaagtcgcctgataagcgcccgtagctcaattggatagagcgtttgactacggatcaaaaggttaggggttcgactcctctcgggcgcgccaatttaaatgcgggtgtagtttagtggtaaaacctcagccttccaagctgatgtcgtgagttcgattctcatcacccgctccattataatgatctttgaaaactaaacaagacaaaacgtacctgttaattcaaagttttaaataaatcgcacagcgtgctgtgcgatttatttaaaactttgaattaacaggtacgttttgtcttgtttagttttcaaagatcatctcaacctcatctcgaggcgacttttttagtataacatttcagcaagttgctgtcaaatgtttttttgtttttatttctccgccgctgtgagctttttgttgaagcgcatcagcgacgtttaataatataacacgcttataaatcagcgtcaacactttttttaaaagaatatcctcgatgatatacttcttgtcctttggtttctatttgggatacttcaataaagcctttttccgtcaggtaatcaagcatgacaccgagatcttgagtgaagtgcgccagttcaggatgctgaagcaattctccaaactgccacatttctttttctttcatcacttgaaaaagatgggcagaaccgatttcagcttttgaatgaatgagaaaatcatttgctaagaataataattcgagtcttttctccaggctttcgtgactctcgacaagttcggaatataacttatacacctgcggctcaatatgacggacctgattccagactgtcgtttccggataaaacccccggtcaatcacttctatgcgggccaagtggtgaagagcatgcactaccgcataatatgcgtccagaaaatgatcagcttcaaaaaacgcttttccttctacaaaccttctgatcagcttgccgtactccattccgatttttaatttgcgctcggcgaacgggaatgtgctgagccggtcagcaagctcagctatatattcattgcggtcaaacagcaccttgccgttgatgatccaatctataactcttctgtttgtccccagcaaaatccattcctgaagcagagcatccgttacaatatgtaaggaagcggttttgtgttcgaattcataatgctttataaaaagaggctcttcagcctgtttgacaatgacaagcatgaccgcatcaaagttatctgtgatggatgatgctttgctccttctctcaatcataaggacggccagcgtatcgggatgacttgctctttcttggtaaattggacggagaagattgtccattacgattcctccaatgcgattgtttcactagctattgtttctacatttctatgataaaacatgaaagtccttttttctaaacacattgcactattataacaaatttcctttcggctgccatatttattcttcccttttcttacgagaacatgaagaatataccatctgttttgtgctatagttaaaccagagggggatggacatggcgaaatactcaagcaaaattaataagatcagaacgtttgcgttaagtttggttttcgttgggtttatcattatgtacatcgggctgttctttaagcagtctgttttgcttgccagcttgtttatgattctcggcctgctgtcgatcgggctgagcaccgccgtttatttttggatcggcatgctgtccacaaaagcggtccgggtgacgtgccccgcctgtgagaaagaaacgaaaattctgggcagagtggatatgtgcatgcattgcagagagccgcttacattggataaagggttggaaggcaaagcgtttgatgagtcttataacaaaaaaaacagtgtgaaataaacaaagctgaccgtatcaaagcggtcagcttcgtttaatggttttcttttttggagcattcttggcagacaccgtaaatctccaaacgatggtggcttaccttaaaccccgttacgtgagccgcaagctgttcaacttcgtcaagcccgggataatgaaagtccacgatttttccgcagttttcacaaatggcgtgataatggtcagaggtgacaaagtcaaacctgctggacgcatctccgtacgtcagttcctttacaagcccagcttcccggaatacacgcaaattgttatatactgttgcgacactcatattagggaatttcccttccaaggctttatatatatcgtccgctgtcggatgagccatagagtccacgagatattccagaatggcatgacgttgaggagtaatccggactcccgtatccttcaacgtgtctaaggcttcttttaattcatgtgcagccatccgtcatgcacctctcttctaaaaaagattcttactttataatgtttataattagtgtacatctttttccggtctcctgtcaaatgtaatctgaagaaaaccccgtgatttcagcatttgtccattaatttgccgcaatttgttccaattcgcgaagagcctccgcaacatgatctttcacttttacttttctccactccttcacaagacggccttctttgtctaacagaaaggtggatcgctcgattcccatatattctttcccaaaattcttcttcagcttccacacgtcaaaagcttccgccagtttatgctcgtcatcgacgaggagctggaaaggaagatcgtgtttctgtttaaattttttatgtttgtcacggctgtcagggcttactccgataatgaccgcatcaagtcccgcaaaactttcgtgctgatcacggaaatcgcatgcttccgtcgtgcatccgggtgtcatgtctttcggataaaaatagagcacgacgtacttccctttaaaatccgttaatgatacttcttctccgctgtcgttcaataattccatatccggtgccgcttgtccgatttcaatcgtcatttcttatacctccgggttttttattaagcgtatccaattcacgttaagattacaaccgttatcccccgctcttttctggaagcaagaaccgttgtgctcgcaatgaagcatgctacaatagaacatgatgtaaggagatattaggagggtcattttttgtatacaaaatcagttgaacttcataaggaagcgttagaacatatcgtcggaggcgtgaacagtccgtccagatcctacaaagcggtaggcggcggttcaccagttgcgatggaaaaagcgaacggcgcttatttctgggatgtagacgggaatcagtatattgattatttagcggcttacggcccgattattaccggacatgcccacccgcatattacagaagcgattacaaaagcagctgaaaacggcgtactgtacgggactccgaccaaacatgaggtcactttcgccaaaatgctgaaggaggccatcccgtcacttgataaagttcggtttgtgaactcgggcacggaagccgtgatgacaacgatccgggttgcacgcgcttatacaggccggacaaaaatcattaaattcgccggctgctatcacggccattctgatctcgtgctcgtcgctgcgggttcaggaccgtccacactcggcacccccgattccgcaggtgtgccgaaaagcatcgccaatgaggtaatcaccgttcctttcaatgacattgaaagctacaaagccgcattggacaaatggggttcggaaattgcagcggtcctcgtcgagccgattgtcggcaatttcggcatcgttgaacctgaagaaggctttttagaacaggtcaacgaattgacccataaagcgggcgcgctcgtcatttatgatgaagtgatcacggcgtttcgttttatgtacggaggcgcgcaggatcttctccaagtgaagcctgatttaacggcgctcggaaaaattatcggaggcggcttgccgatcggcgcttacggaggcaaaaaagaaatcatggagcaggttgctccgctcggcccggcatatcaagccggcacgatggccggaaacccggcatccatcttatcaggcatcgcctgtttggaagtgctgaaggaagaaggcgtttatgagcggcttgatcagctcggcgccagacttgagcaaggcattctcacccatgcggagacacatggcattaccatcaccgtcaatcgattaaaaggcgcgcttacggtttatttcactgatgaaaagatcgtcaattatgagcaggcggaaaatacggacggagaagcatttgccaagttctttaagctgatgcttgagcgcggcatcaatctcgccccgtcgaagtatgaagcttggtttataacaaccgcacatactgaagaggatatcgacgccactttaaaagcggttgaagatgcgttcagacatatgaaaaattaactgccgaaacaagcgggagcccggggcttccgctttttctttttgtccgatttgtgagataatggttttttcaaaaaaagaccttgaataattagcacgatccctgtatattactttattgtttagcaaatcaaccgacagggaaatgtaagtgtcagccgttcgttcggcacataatttattagagaaaggaatgcacgcacaaaccaatgaaacttggtgcccgcatttttaaaacagggattgcgattacgctcgcgctctacttagcatcatggatcggacttccgtcgccgatctttgccgggattgcagctatatttgccatacagccctctatttacaggtcttttcttatcattattgatcaggtgcaggcaaatatcatcggcgctgtcatcgctacggtattcggactgattttcggaccgagtccgattatgatcggactgaccgcagtgattgtcatcacgattatgttaaaactgaaaattgaacacaccatttcgattgcgctcgtgacggttatcgcaattttggaaacaccgggaaacagcttcctgacgttcgctctgatacgaacaagcaccgttattttaggggtgctgtcttctttcattgtgaaccttgtgtttcttccgccgaaatacgaaacgaagctgactcatcatacggttgaatataccgatgagatcatgaaatggatcaggctgacgatgcgccagtctacggagcactcgatattgaaagaggatattgagaagctgaaggaaaagatgatgaagcttgatcatacgtaccttctttataaagaggaaagaagctactttaagaaaacgacgtatgtaaagtcacgcaagcttgtattattcagacaggcgattattacggcgaatcgggcgcttgatatgctgaaaaagctgcaccgctatgaaaatgagatttatcatatgccggaggaatttcaggagacgctgacagaagaaatcgattatctgcttcattggcacgaaagagttctgatgcggacagtcggcaagattaaaccgcatgatgacgatgctgaagaaagcattagatataaacagcttttgacgaagtctttcttaaaaaaccagcagaactgcgaagatgaactgcttgattacaatatgctcagcattatggctgcggttgcggaataccgcgaacagctggagcatctcgatacgttaatcacgagttttcagacataccacccgaaagacagcgaattagaaacagacgatgagtaacccggtgcttcagcagaaccgggttttttgtataaaaaaacttatgccgccaaatcggacggcataagtttttcggtcagtttaaattctggatcgtaaataagtgtctgtactggccttcccgcgccattaattcctcatgcgtgccggtttcaatgacggcgccgttttccataacgacaattttatccgcgtgcgtaatcgtggacagcctgtgagcgacgataaatgtcgtccggtttttcgcaagcttgtccatcgcttcctgaatgtagtgttcactttcaagatcaagagcggatgtcgcttcatccaaaattaacagcggcggattttttaagaaaacacgggcgatggagatccgctgtttctgtccgcctgacaatttgacgccccgttcgccgactttggtctcatagccttctgggaagcccataataaattcatgggcatttgccgctttcgcagccgcaaccacctcatccaaagacgctcccggtttaccgatggcgatattttcacgaatcgtctcactgaacagaaatgtatcctgaagcaccattccgacttgattgcggaggcttctcgcttcataatcgcgaatatcggtgccgtcaatgagcaggctgccgccggacacatcataaaaacgcggtataaggctgacaagtgtcgatttaccgccgccgctcatcccgacgagtgccacggtttccccttttgtcacctttaaagaaacgtcccgcaatatcgattctttcccttcttcgtaacggaaggagacatttcgaaattcaacctcgcctttaatgccgtcagcttttaccgcattcggtttatcagtcagttcatacggttcgtcgataaattcaaatatgcggtccattgaagcgatcgactgggtcagcgtcgtcgatgagttgatcagtcttctgaccggattgtacattctgtcaatgtagccgacgaacgcaaccatcgtccctacggtcagcgggccgtttatgacaaaatagcccgcaaacgcgataacgagcagcggcgccaaatccgtaatggtatttacgaccgcaaacgttttggcgttccaattcgtatgacggatcgctttgtcaagaaaatgtccgttcttttcatcaaaattggcttgctcatattcttcaatcgcgaagcttctgataacgggcattccctgaactctttcgtgcaaatgcccctgcacctgagcgagtgcctgagagcgctcgcgtgtcagtttccggagacggccgtaaaagtatttcactgaaatgccgtataacgggaacaaaatgacagaaatcaatgtcagtttgacatccaatgtgaacataatgcagatgacgatcagcactgtcatcatatcaagccagatattcatcagtcccgttatgacaaagtcttttgtctgttcgacatcatttatcacccgggaaatgacttcgcccgttctcgtgttggcataaaaccgcaggctcagtttttgaatatggtcaaacaatactcccctgatatcgtagagcacccggcttcccgtccattgcgcgaaatattgccgataatactctaccgggggacgcagaactaaaaacagcacgaacatgatgcccataatcgtgaatagtgtcgatgttttagcgcttgccgttccgctcccttgaataatgtcatcgaccacgtattttaacagaagcgggagagccagcgggatggagaattttatgataccgattaacactgtgataaagatttgttttttatagggttttacaaattgcatatagcgtctgattacgcccacactttatccccctctctctttaaggcgtgtgagcccatgtgaaaaacctgttgacaccccaacaggtttttattgtattctttattttgtatagcgcagataccgttcataccacatatcaacaaattcaggagcaaaagggcctttccgctgatgaatccagtgcagcagcgtattcagatactccttcagaatgctgtcgatctctttaggataattcattgatttgcggtgatcatcgtattcatcctcgtccagaatgttatatgtcatatccggaaacactttgacatccaaatcgtaatcaatatatttgatggcctctccgtcataagcgaacggcgagctgatgttgcaataatagtgaactccgtcatctctcagcattccgatgacgttaaaccactgacgggcatgaaagtagcatatcgccggttctctggtcacccacgtccgtccgtcggattccgtcaccattgtccggtcgttagctccgatgatacacaattccgtactttttaaaatcgtcgtttcgttccaaattcgatgaagcagcccgttatgcttatagctgtgaatttgaatcgtttctccttccttgggatatcccatatttctcccctactttctgtaaagccctgcagtcaatgcagccgcaattgctttccgacaagtcttttcactattataacgttacgaattaaaaaatgaaaataaaagaaccactccgcttccggaatggcacattcatttctgcacataggaagacggcttttccgtgctgcgataagactggatgacttgctctgtctgcctttggaataactcctgtatgccggccagatcttttcgctttgtcgcaatttcgtcctgtacattgtccagctttgcatctctttccagactgatgagttccgcttccacctgccggcagcggtcaagttctgactgcagctcgagaagctgatccatgatcttcatctgttcacttacaagcttttcaaactctgacatcgggttcctccttaggcttttaggttgatactacttaccatttcgagtttctgccggaaaaccctttgactcattctgtagaggaatcacaagttttgtcgttttgataaaagaaaaaagcacttccacccgaagatgaagtgcttttttgtttcagtgattagctgttttgttgtttgttttgctcagcagattggttttgctttctcacctgctgcgcatcagtttcactgccgaattcagtaccgtattgaccttggccggaagctgattgctggttttgttttttcacctgctgaacgtcagttttgctgtattttgagttttccattgttatcacctccacgcaatttagaatgcgcaggagacgatcaggctattcatctttttaaaaaaacttacacgagcagagagcgtccgccgtcaataatgatggtctgaccgcggatcatgtccgcttttgaagaaactaaaaactccaccgtgtcgatcatgtctttaatttcgaccattcttccggccggcgtattttgacgggcatcttcaagcaattcttctctgttagggaaatgcttcagcgcgtctgtatcaatcgctccgcctgaaacggcattcacgatgatatttctcggcgaaagctcaaccgccagataacgggttaatgattctaaagcggcttttgagacaccgaccgtcgtatagttctcaagatagcggatgctgccaagtgagctgatgctgacgatgtggccgcctccggttttttccatcagctttgccgcttcctgggcgcagaaaagcaatgcttttgcgttaatattcattgtccagtcccaatgcgtttcttcaagttccatgaccggtctcagcacgcctgaagccgcgttattgacgaacacgtcgagtctgccgaaggcttcgtcgatctgacggaacatgtctttgatttttgccggctggccgacattggctttaacgacgagcgttttgacgccaagtttttcaatttcttcagctgtttctaacgccgcttttttactgcgggcgtaattgattacgatattgtagcctttttccgcgagtctgatggctgctgctttcccgacgccgcggctgcttcccgtgattaatgcgcatttattttgttccatttttcctcagctccttgctgcgtatagttcttttcattcaacaaacaataaaagcattacctgttgaaaggggtcttttcatatgtatgtcggacgtgatatgggcgaattggccatgatgccaaaaaaagattggaaggattcagagctcgcctatttccatcatgccttccagcaaattatgccgtatttaaacgaagaaggccagtccaaataccgggagctgattcaggaaattgaagcccggggcggactgaaacggaatgaggcggattacggccacggcacacgcgtcagctatgactgacgcttcttaccggcggccgccttcgtccgccattttccaaatcttttgatgggaaacgggaaaagcgtattcttcgagttccccttttgtgacccgtattaattctgatgtgtccgacacttgttttactttaccgaaaaagaccgaaatattccagacgagatgagtgaaaacatgttctacgatgccttccagctctccgatttcagcggttgctcccatttctttttctaaaaaggcttcgagctgctctcgttcggttttggttcctttttgggtttcggtattcggaaactcccacagattggcgagcaatccttttggcggccgtttatgaatatagacattgtcttggtcgtctgtcagcacaacggcggccattgtttttactccgggttttttctttttgcttttaacgggcagctccctctctgtcccttctgcaaatgccgagcagtgcttttgcacgggacacagcaggcaggacggagatttcggggtgcagatgatcgcgccgagctccattaaaccctgattgaattcagatggtttttcatgagaaatgaaagctgataccgcctgttcgaaaatcgttctggttttaggttttgcgatatcgtcccatatggaaagaattctcgacatgacacgcatcacattgccgtctacggcgggaatcggtttgttgtatgcgatgctgagcacggcgccttttgtataagggccgacgcctttcagtccgccgaattccttttcctcagcaggaacgattccgccataccgctcgtgcacttcctgtacggcgctttgcagatttctcacacgggagtaatagcctaacccttcccaggctttgagcactttttcctcatcggcctcagcaagcgccgagacggtcggaaactgctcaacaaaccgccggaaataaggaatgacggtttctacccgcgtctgctgcagcatgacctctgacacccacacccgatacgggtcctgattttctctccatggcagaattctttgttctctttcgaaccatgtaattaagtcctcgcgaaatttgtctatatctttttgtttcattttttcttcaagtgcgttcatatcttctcctcagatgtttcgggtcccgcttttcttgacactgtattttggtgtaaactaagggcacgttacgataatatgttacattaaatagagataaagaaaaagcggaaacatatgaaaacggctgatacacgccatgattgggcaaacagaaaatggggaatatcttataatggaaatatgcgggcggactgatttttaacgcctgctaggaggtcaccaatggatactggcactcacgttgtcatgggcatcgcgcttggcggaatcgcaactcttgatcctgccgtcggcatgcatacccccatgtctcaggcagttatgatcgccgctcttgccggctctcaggcacctgatattgataccatattgaagctgaaaaataatgctgtttatattcgaaatcatagagggttcacacactccattcccgccgttttattttggtccattctgattccgggcattttgtttatattttacccggaagcgaacttgctgcacctgtggctgtggacgcttctggctgtcgttttgcatgtatttgtggacatttttaacgcgtacggaacgcaggccatccgcccgttttcgcgaaaatgggtcgctctcggtataatcaatacctttgacccgtttattttcatcagtcatttggccgcgattgccgtgtggtatatcggaggtcatccgggcgtgacatttttgacgctgtatatcatccttgcgggttattacgccgtccggattatcatgcagctgcggataaagctgcggctgcgcgagatgattgaagaggagattgaaaccatcatcatttcgccgacgatgaaattcaggcagtggcgtatcgccgtaacgacggcccatgccttttatgtcggcagaagccttgacggtcatgttgtgatattggatacattcaaccgtgtgcccgttccggaaaccgatgtgatgaaggcggcgaaacaagatgaaaatattgcagcttttctttcgttttcccccgtttacaggtgggaggtcgatacctttaaagatcattatgaggtgcgctttattgatttgcgctaccggagcaaaggccactatccttttgtcgccatcgtccacctcagtcatgatttagaggttctttcttcttacacgggctggattttcagcgaggaaaaactgcagaaaaaattaaagctcggctctgtttaagagccgggctttttttgtcttctcacatatatgacggcaaacacgagactgatcaccgatatagcggccgccggtttaaaatacggcggataatacgttaattgaatatcattttttcctttttgcgctttaaatccgataaaggaataatccgctttttcaatctgttcttgtctgccgtttattttcagctcccagcctttttcatatggaatcggaagcatgatatacggcgcgcgggttttgttttcatacgaaatatgaagcgtatttccgcgccagctgaggtcggctggcggttctttttccgcttttcggtatgcgcttttcagcgtcgcgtaccgttcttcgtaaagcgccagtctgtcgagctgatacgatcctttcggcagccggatttggatgttttttgttttcggcactctgacggtgagatcgttgacacctgttttgtaaatggattgattcgattttctcgttgtcgtgtaatcgttcacttttaatgtaaagccctggtccttcgctttgttcattaaataaaagctgacgtaataatctccgccgtcagccgcggcgccgtgcggcgtaatgatcaggccgcctccgtcttcgtttaccgtcaggatgccgtcacgataatccgcatgttcgggggctatctctgcctgacggatgatattttccgcttctggcggttttttcgtttttgttgtgttcgattccgtgacgatcccgtcaagcattgcccgttccctggctagggcgggcgcttttttcaggtcgtcctcgttatatactcgatcggctgtccgtacgaacggaagtacatattgattttgataaaccgcatagcgggatgattccatgatctttttgaacccgtacggcacgccggcctcgtttgttttttccgtcatataatattttccgtaaagcaggctgtataaattagccctgtttcctaatgtcgcatagcggcttacgctttctctgcccatgtcaatctggaggtcattccagtagaaggacagcagattgcggttcaggatgcttgagtaaacgctgaatccgttgaacccgtatatgatcggggtattattgaatacgccgttcatccaatctaaacgggcaaaggggtccgggtctttttctttcagacgctgaatgagctctgcttgttctttgcctttatagtcaggacccgtcatgaatgtatgcgataccgtataaatcttcccgccttctgataaagcatatttttcatatgtattggccgtcagcaccgcagtcaagagaatgacgccataaacggcgggcaccgcgcctctcagtcttacctttgctgcaaaaaaagcggcaatggtcagccccagaaggagcaggatggacaggtaggcgtgatcagaaatatccaggctgaaccgtctcatctggctccaatagagcagaacggcgagtacggcggatatcagcatactcttcctgctgatgtccgaaagcttagaaagccctaccgcaaccgttcctgcaaccgtgaagcacaggacgtattcaaacctgttttgcggagctgaaaaaccgttaaaggcgcttgccgcaaacggactgaagtgaaacagaatatacagcagactgattcccgcaaacagccggaacaaccggtttttgtataaagaaaatgtaaatagaaaaagcaaaaaagccgccggcaggatgataatccggcttgaaaataaaatgttgtcggagaaatcaagccaatcaatatgctgtgaatacggcggccgcagattattgagatatccgtacacgacagggataaaggagactgcgcttataccgaaaccgagcaggcctgacagaataaacatccggcattgagtgagccttttcgcctcattgtcttcaaggcggatgatccaccggaataagatgtaaatgccaatgaaaatcagattaatatacgcaaaataaaagttgttgatcaatgtcagcgcacaggcgaaaataaaccacgccggctttttttccctgatgatcttttccgcgccgaacacgagcagcggcagccacaccatgctgtcagtgaaaaagtcccaatacacctcatgccggaagtagataatcgagaccccgtacaacacggcgccgacaaaagcaggcaatgtccgtttgacgaaataacggaacacacaggccgccgtgaatatgatgaaactctgcttggcgatgctgataaaaacggaggcctgcgcccaaaacagcgcatccgcctcacccgacagctgcataagctgcagaatgcggacagcggcggaaataaacagaaaaagaaaagaagtagagaaataatagccgagctgactgtacactcccccgcccagtccgaacgaatagctgtaaaacagcctgccgttcatatattggtcaaacagcagctttttgaagaccgccatttgggcgatcccgtctccagaccccgtcatatagcggcctgccgaccactcttttaagaaaaaaacatgagcggctgccgcagccagcacacaggctgccggcaagatccatttattttttttcatacaacgtctccataccctgcgcacagcggcggctgtttaatggttccacttgcgcttttttgtataattcgtttcattttgttctccgtacgtaatattcgcttctttaattaaatagtgcgggcgtttttttgtttcatagtaaatccggccgatgtactccccgatgatgccgagactcaaaagctggatgcctcctaaaaacagcacggcggaaataatggtgaagtatccgggtacggacacaccgtgtgtcagaatatgaataaaggtcgtgacaatataaaccatcgacagaagcaatatcagaataccggtgaaaaagcaaaccctcagcggtttgttgttaaaggagacgacgccgtccattccgtagttgaacagattgctgaatgaccatttggacgtgccgttctgcctttcgacattttcataaaatacgattttctggtcaaatccgatccagcagaacagcccttttgagaagcggttcccttcactcagcttcaaaagggcatctacggcctgtcggctcagcaggcggaaatctccgaccccgtcacgcagatccacttcgacggctttgttgataaatttataatacagggaagaaagcacggaacgcacggggctgtccccttttcggttgcgctgcgcaatgacttggtcatacccttcttcatagccttgaatgaagtctttcagcagatgcgtcggatgctgcaggtcggcgtccatcacgattaccgcttcgccctgcacgtgttcaaatcctgccaagatggccgcttcttttccgaagttgcgggaaaaagatatgtatttgacgcgatggtttctggcggccacttctttaatctgctgaagcgtgtcatccgcgcttccgtcattgatgtagaaaatctcatagtcataatgaatcgtctgaaactctttttttaaagattcatggatgagcttgacgttattcccttcattgtaagacggaataataattgagattaacctttgtttcatgaaggcaccttctttgtattattcttttttagtacggccttaaaggcatagtccgcaaaacttcagtaaggcttttcctttttttaatgtcgtttaaacccttttttcgttacaggggtaagaaaaatttttctgcatatggttttattttgtcatgtttttcggcagatatgagaaaaaaaagaaaaagtctgtacccgggacagactttattgatgaaggtattcatgaatcaaatggctgacgatgcgcggtttttcgtgaatgacccaatgggaggcatcatcgatgaatattaattcgccgttgggaatcatccgttttgtttccacggcgagctttttgcttagcgcacggtcattgacgccccatatcaatcggtacggaacgggcattttaaacggtacggcaggtcctaaaccgccggctctgatcgcccggtaccagttcagcatagccgtgagcgctccttttctgtcccatgcttctttgtagctgtcgacatcttcccgtgagaaaagctccgggcgttcggataagccgatcgcatgatccaatacgcggtaattgtcttcagataatctccgttcaggtttttccggaagctgaaagaacgcgatataagagcttttcttccactgcggcgggtagaacggggtgaccttccgcataaccgccgggtgcggaatattgaccgtgatcaatttttcaacgtattgcggccgcgtggatgccaagtgccaggctacggctcctccccaatcatgaccgatgacgacggccttgtcatttgtaaaatgagtgatcagcccgataatgtcgtctctgagcgtatcaatggtatagttttcaatgccttcaggtttatcactgagattatatccgcgctgatcaggcacgacaacatggtatccggcatcggcaagcggtttgatctggctcttccagccgtaccaaaactccggaaacccgtgcagcagcaccgccaaaggaccatctttcggaccggctgaagccgtgtgcagcgtcaccccgtttgtttcgatcatatgaaaagtaatgtcattcaatcggttctcctccccttttgttttaatcttctttctgttaaggctatgatcagggcgctgatcgcgatcaataatacggcctgaacggtcaggctgtacggctgagtgagctgaatgagcaggctgcccgcaaatccggctgcagccatcagaaggccgaacagaatcatgaggagcgcactgaaacggttgccttctttccactggaattcatccgccatagaccgtttcgtccgatatccgtacaggctgttaattgacttcggcgggaaaagtgtgactaaaatgccggccgcagccatcagaaggcctccgattaccattatcatatctgtcactctccttttcatttcatacgaaaggaaaggcggaaagtttcagaaaaaaagcaggctcatccgcctgcctgaatctctatttttgagctaagtcggccgtcttcacatagcctgctttcccgccgtatgtgacgtatgcccatttacggtcaaatcctccgtcatggctgaatccccagccgagcacattgacggtttcacccgctttaacggagctttttttgccggtttccaaagtcggcgtataaaaatcggtttgtttcgcggtcactgccttcatcggctgcttcatcagaaaatgagtggagatataggctttctgacctttgtagttaatctcggcccaatctgccccttcaagctgtttaacctttacggcatcttctgaacggagcgtgccgacaatcaccccttgtttatttggttctttacggacgttaagttctcctgctttcacgatatatgtatctgctgcggtgtccagttttgtctgatgagctggtgcggcattcgctgccggatcaaaaaaaacggtgcctgcggctaaaaataagcaaagtcctgcggccggaataaatgcggttaacccttttttcatgttcattgtggttcctccccgctattttataagttattacacatttccacactccgcgggttatcaaacatgtttttcctatttcttttataaaaagaaaaaaccgccgggagatatccggcggaacgcactggtatgttaatgcaggagtcccctgctttgatccaaataatgagaaacgtcttcccgcatgctttggaacatatggagcttgctgccgtatgattcaatccattccttaacgacgcgttctgtcatttgctctccttgatacgggcggccggcttttgcgtaagtcgcttcgaaatctccccataagagctcaacccaagttcgcgcttgcaaatagctgatcatgtcatttttctcaagcagcaaattcgtcagtttgtcgatatatgtattcatgtctctgtctcctttccttgggaaaacctgctgcttttacacagcttgtcacaggcatatactaactttacgtcttcagtccagaaggcgcaaccttttgatattggccgagggggaaaacaaatggtccggaacaaggcaaaaggatttccaaatcagaacaacaataagtttgaaggcgaaccgcgggcaaaggatgactacgcttctaaacgggcggacggttcaattaattcgcacccgcaagagcgcatgagagcttcaggcagacgataacacataacgtaaagagaccgggaatggcccggtctcttttttgcggcgaaaaaaaggtcataacgccaaacaaattccataatatgttaaatgttaaaccgaaagccggtagacaaaaaaggagggggttttatacaatgaagacagtttcaaaacgattgctgagctttaccgcattctttctgtcagtttcattatttgctgtttcagcagaagcccaaggcagtccgcagacatccgtatcgaacagcggtgaggagtttgacgcaagtccgaatcagcctgtaaaaacaacacaaacatctccagcttatgaaggaacgggcctcaccaaaaaacatcctgcacaaaacggcaaagccgacatcaagtcattaaagccttccagtattatagggacagacgaacgaatcagaatttctccgacaacatcatttccttatcgcgcgacagcacagctgaccgttacatacagcggcagcacaagcacttacggatgcaccggattttttgtcaatgcagacacgatcgtcacggccggacattgtgtgtatgatcagaaaaacggctgggcatcgaaaatcacggcagctcccggccgcaacggctcatcgtacccgtacggatcatattcaggcaagacattctacagtgtcaaaggatggacagaaaacggtgataccaactatgattacggggcaattaaagtagacggatcgcccgggaatactgtcggctggtacggctaccggacgaccaacagttccagtccggccaggctgtcttcaactgtgacgggatatccatgcgacaaagtgtccggttccatgtggtctgacagcaagccgatacgttcggccgagacatataaactcacttacacgacagacacgttcggctgccagagcggatcgcccgtttatcacaattacagcgataccggccagaccgccattgccgttcatacaaacggcgggtcgacttacaatctgggaacaagggtgacaaatagtgttttcgacaacattcaatattggtcaaatcaataaagtttttattttctttctcgccgcggctgttttatgcggatgcagcaaagcggatgattccgccgccggcaaaaaaacactgcccgttactctccattttgaggatgctgacggctcacctgctgacggtgtgacggtcacagtgatgaaagcggcggagtcagatgatcagccgaatatagaccgcggagagataataggcaagaccgatcaccacggcaatatcgcctggaaaagcgggacggaaggaacctatgccgtcgtttttgaaaaagacggcataccggaaacccggaatatttccttagttgagagcgataaacatacggtgatcagctttacattgaaacattaaaaaagcttgcaggcggattatccgctgcaagctttttgttatcctttatgcacttggtattcatagacatctttcttctcagacagatgagcgaatgtggaaagcacaaggccgagagcggtcatcagcgcaccgcctgcaaacagccatgagtaagatcccgttccgccgagaatcaatccgccgagccaagcgccgagcgcgtttgcaaggttaaatgcggaaacgctcaccgcggcggcaattgtcgtgccgttttcagatgaagaaataacctttgtctgtaaaagcggcggcgtgccgaacgcgcatgcgccgaataaaaatgtcgcggaaacggccgcggcaggaaaaacagcgatataagggaagatcgccaagacgccgatcaagccgatcatcacaccgatcattgtgcgcgtcagcagtttgagcggcactttccctgcgaagaaattccccgccactccgccgagaccgtaggcaaataatgcgcctgtaatgccgaccgtgccgaatcccgctgaatctcttaaaatcggctcaataaacgtgtaagcaataaatacgccggagtagccgagaatggtgatcgcaaaggagaagatcacttgcttatgcttaaagacactccattcattcatcagcatcggaatcactttcggttttcgattcggtacgaccagcatcaggccgatcagcccgatcatgcctaaaacggaaataatgaaaaagacggcccgccagttaagaacatcccctaaataagagccgaacggaacgccgagcatcagcgccacggttaatcccccgttcatggacgcagctgcggcggaacgtttttcaggcggcaccatttcactcgcaaacaccatggcgatcgcaaaaaaggctccgtggatggatgcggataaaattcttgaaatcgccagcacggcgaagtttggcgcaaagacgctcatcaggttggcaaggacaaagatgcccatcaagctgagcagcaccggctttctcggaagtttaaccgcgataatcgttacaatcgggcccgtcaggcagacgcttgccgcatacgcggtaacaagcatacccgctgaagaaacatgtatatgaaagtcatcggcaatcgacgtcagaatacccatgacagcatattccgtataaccgatggaaaaagtgcaaatcattaaaacaaaaatcattaatttcacagatggctgtttcattttgatattcaacgctaatcgcctccttttactaaaaaacaacgaattccatcttaaaagatatcgaaaatgaattcaaacattttttactgaaagtgtgaaacgaatgtgcccgaaaataaaaagagaccggatccggtctctttcgttaacttttttcttttaaaacggaaatcggcagtgcttcttcctgatcaggcgacgaagatctgtgtccccaggcgaatacgccgttcatgtaatcaatgcggaacgtatcatcagtaccttctatctgatactccgcgcccggcagaaagtcttccgggttctgcatgtaggctttggccatcgtgattttccgttcaagcacggccagttcatttacaatgcccatctgttctgcttttcgcgctttttccgtcaggcccgcaatttccgtctgtagttcatgaggcgtcatttgactgtatcgtttgtccatttcagcttactcctcttcctgcaaaaattgttcaatgtcgtcaatcgagaatccttttctgaataagtactgcttgaccttcattccgctttcatagctgccgtcatagcggtatttcctgattgctttttccgcatgagtcttcaaagcttccatctcagcttcgtcatcattctcatactccgtctgctccagagcggcattgatgacgtcgaaagggaagccttttcgctgaagctgcatctgggcccgctgtctgatctcttttgtggacagctttttgtcttttttcaggatttttccgatatgtttcagcgcttcctgtatctgctcatcaaacgtaaacgcactgagcgtctccttaatggtatcgtcgtctattcctttcgctttcagctcgcgaaacaggacgtcaggccctttgccgtttgtttttttgtgggtgctcgcataggcttcggcaaattctttgtcatttaagtagcggtaatcgtacagtttgtggatgacttcagaaataaccatctcaggtgtttctttttttttcaaatggtcccggacttctttttcagagcgcatccggtatgataaaaattcgacggcgcggttaaaggcttttttcacttcatcgccgtgactgatttcaagaatgtcaagctcgtccagttctttcccttttttcaggtcaaaacgaacaagcacgtcggcgtcgacgctgaatgcatatttctcatcaaggaagatgttgaagcgttcggtatttttcttttgggtcgatatttttgtaataaacggcatcccgatctcctttcccgccccgattttcaggcgtttttcttttaggcaaatgaggtaaagtatatttatcaacgtgtaaggagagatggatatgaatatcgcgatgacaggcggcacgggttttctgggccggcatctgacaggtgtgtttacccgccagggacatcatgtctatattttatcaagaaaacaaagagaaaccgaacaaaaaaatgtgacatatgttcaatggctggccgaaaacgcggcgcctgagcgcgagcttccccctattgatgtatgggtgaacctcgcgggcaaatccatctttgaccgctggacggacacaacgaaggaacaaatcatctcaagccgggtagaagcgacgagagaagtcagacggattatccggcagcaggcaaaaaaaccccgggctttaattcaggcaagcgccgtcggcatttacggcacaagcacagagaaaacgttcactgagcagtcagatacgtcaaatgaagacttcctcagtcatacggctcatatgtgggagcgtgaaggccagaaaattgaagcgctcggcattcggacggtatatgccagattcggcgtgatgctcggtgaaaaaggcgccctgccgctcatggttctcccttataagctgttggcgggcggcaccgtcggctcaggacggcaatggctgtcatgggttcatgtcgatgatgcggcggaactcatcgcttatgcggcggagcatgatgacttgtccggcccgatgaatgtgacctcgccgaaccctgttgaaatgaagcaattcggtaagacgatcgcaaccgtcctgcaccgcccccactggattcccgtaccggaattttttctggagaaggcattgggagaaatgagcctgctgatcgtaaaagggcagcgcgccctgcctaagcaggcgctgacatccggttttcaatttacgtatgaagagcttgatttcgctttaaaggatctcttacctgcataaaaacggaaataaaagccaatcctattggtattctgttttgaaggaggatcttcttttatggaaaagaagcgcgaaaaacatcagcagggagccaacctgaaaaaaatgcaggaagtcctttattccggtgaattcaaaaaagcggaaaaagcagccaaacggaaataagctgaataaagatcgggactgggcagatactatgtttgtttgatatcacttttttcagggggcgattgatatgggcagaaatcatactcacaaaaaccgtgataaaaacaaacaaaagcttcctcaagttccggacgctttgaaacgcgaaacggacggcacatatgaggaatattcaagcgagcttgctgattccgctgaccgcgaagcgcaggcgcggatgaaagccgctgacaacagagctaaaagcaaaaaccgctaatacaaaatccccgcctcttgaaggacggggatttttttacagttcggtaaacaggctttttgccggcgtccgttctttcgccttaggctgttcatccggatagcccgtttgaatgatcgccgcaaagcgctcattgtctgcaaggccgaagtcttgatgcatctgtttgtcatacatgatacggccgcttttccaaaccatgccgatgccgttttcatgtgcgagaagctgaaggttttgaatcatgccgctcagcgcagcgaaatcatcgtttctcgtaaattcattttcatcttcttttaagacgaccaataaaaatcccggaacggcgctgaggttttttctcatgttctgctctttttcctcgttgaaatcatcttttatcttcttgaaaaatgagacgtagctgtccgcaagctttgcttttcccgcttcgcttgccgcgtaaataaaacgccacggctccgtcagcctgtggttcggtgcgtaaacggccgtttcaagcatatctaatatgacttcagaaggtacggtttccggtttaaacgaccggatggatcttctgtttctgatcgtatgtttaagtctctcgttttgctgtgattgttcggttttcggcatgccgattcaccttcctattcaattgaaaatgattatcatttataatataacggatagaaccgtcttttgtaaaccgttacggaagctgaagattgattgattcggcatacacagccgttcccgtcatctggatattcatctctccgtcttcctccgtgatcctgatttccacttttccgtctttccctatttcctgaccttgttcaatcgtcagccattcggcaccggagcctccgtattgccgcatataggctgccatgacgcctgaagcggttcccgtgacgggatcttcggtcgttccggaaaagggggaagaaaaatggcgtccgtgcagatcgctttcagaatgcacggtttccagagaaaaaggatgaacgctcgctttcgggagatcgtgtaaaatggcgggaaattgtgtgttgtccggcaccatatttcgtgatgcttccagtgatctcagcggaacaatcagtgtccaaattcccgttgatccgtaaacaatcggaagctcatcgtgaaaatcctccgccgtaatgccgagagaggccgcaagcttttctttgtctcccgtaaacggcagaaattgcggggaagcctgtttgagcgtgatgtacacccgcccttttcgttcagcggcttttacaggaagaatgccggctttcgtttcaatttgatacgtctgatcagcctgaagctttcccttttcaattaatgcatacagagaggcaacggtagcatgtccgcataaattcatttcatggccgggtgtaaaatagcggattttcaaatcggcttctccgcttttgcagagaaatgatgtttcattgtatcctgccatttcggcgatcatctgcatttcttcatctgaataatcatctccgttaagaacgattcccgcgggatttcccaaatcaggaacatcggtaaacgcttcgtatttcaatacgtccgcctgtttcattcatcaatcttcctttcgccttatgatcatgttattcagtataacaaaagaagcgggaattttcggttaattacccagaaaaaaagacgcctttttaacggcgtctttttttggtttttccgatcaggcgggtgacgagaatcatcgtgacggacagcgatctgtttttgcggtacgccaagtatttcccgcgccactccggtttgtatttttctttaaaggcccgcagaccgctgaagctgtacatataccggacgttgttaaagatgacggccgcgattctttccgaccagaaggatgaaaaggccgttcctacgtttgacaaaggcgccatgcccatattaaaggtggtgtacccttgttcctgcgcccagagaaacagacggatgaaaagcgcgtccatgataccgttcggcgcgtttttccgataacgcattaagtcgactgatatctcgccttcctgatacatcggcataaggttggcaaaagcgatgatctccccttctgtgtctttcacgtaagcaatcggggcctgttccaaataatcccggtcgaagaaaccgagagaaaagcctttctcttttttcggtccgagccattcgtccgaaatatctttcagtttggcgataaactctgaggaaaacggcggttccccgacatgaaacgtgtagccttcgcggtcaaatttgttgttaatcgcccgcagacccgcttttttctttcctgacagcgtaaatgcctccatatccacgagcgcctcttctccaagcttgaagaagttatagccgaagtcatgatacagcgccatgtcttcacgttcaatctgatagaacatgacactcaggccctgcttatgcgcctcattcagaaattcctcaattacaagcggaaaagagtctttctggcctgacggatcaccgagcacgacaagccttctggaaatctggccgaacaataaaagtgctttgccgtcgcttgagaaataaaaccgcttatccccgagaaagccgaggtggctgagcgcgtttccgccttcttccgccaaaaaggacttcagccgctcaggatcggcctcttccccgatcggcttcgatcttttatgataaattgccgtaaacacaaggaaaaacaaaggcacaacaataatggccgtcatcgtggcgtatgtaatgtgcgaattgttatggacgaaataatcgtggcgcagcagccgattcattttatcccagataaagccggcaatgagattgtagttgaacaaggcgataataaacagagcggccgcaaaaatcatctggccgagcgtatacgatgcctgttctctgataaactgcctctttaacagcacaagcaatacgataacgacaggcagaataaagatcgcgctgatgttcaacccttttaagaaactgaacacaaaaccgccgacaagcgcggcgaccgccattgaataagagcgtttcgtccgtttgtatagttcaatcggcaaaattaaaagaatcaaagccgcgcttaacgataacgcgttaaacgcaagaagcgccggatgcggaatatgcggaatgaccgtctccctgtcgatcggcaaggcgacagacgcaagcacgacgactcccgacacgaaaaccaaaagcgccagcgaaccgtaaagcattctgattaagatggcgcgctgcaatacgagaagcacgttcgtcgtttccacggcaggagccatcttcggatttgattccagccgtttaagcgtattttccgttaagtcgccggccgcaaagaacagcccgaacacaaacggaataaatgaatacacaatccggtagatgacgatggatgtcacaaccgcctcctgcggaaagcccatattctgcatgccgagcagaaacagaaggtcaaacgagccgaatcctcccggcacaaggctgatgattcccccgatagcggcaatggcaaatacaccgaatacatggcggacatctgcttgaatgcccatgacatacagtgaataatacatgacgacggctgccgcaaaccattcggcaaacgatgctccgatgtatgaaaaaaccggatgcctcggcttggcttcaccatcttctgtgtcagcttttttattgttgatccgggcggcgattaaagctgccggcacaatcagcgccacaccggcgatgacagcccacagccacggcttctcgcttgtgatttcacccaccgggagcacccgggcgacggtcagaatactgaagaccgacagcccgagcagagctgaagaagtaagccaagcgattcctgcgacaagacgttttacgtcattcgtgtgctctttgtaaagcatcgtccgcagtccgacacccgccagaccgccgaatccaaggacattgttaaaggaattggcgataaaggaaaccctgaacactttccaattcggaatgttgagacgcagcgttcgtttcagcacaaagtcataaaaggacatcgcactgacggcaaggaggccgagcagaacgagaataaataaatcgtaacgctcaatcccgttaataatgtacagcgtgcgtttaaaagaaaggtctgtcaattcctttttggactgataaatgactaaaagcaaaactgcaataggaaataatacttttaatatcgataaggcattctttttagtcagcaatgttctctccaatcatcataaaatagcttatttattataattcccccaataatctccaacatattatacactaccacctcatattcaaacaaaactcgtctgcaactttctttctcagattaaaatcagtaatatgggatacaggagtattaacgaggaagtgagacgatggattataatctgcatgatacaacggtattaggcggcgatattttttctcctgaggaacgggatatttgggttttgtatatgaaagtgatgacatcggcgggactcggcgatgtgtcagagtggatgaagcttgatatgagcatgccgcaaatgaaggtgctgatgcttctgaacaaccacgggacactgaaggtgagtgaaatcgcggaaaaaatgggcgcttctctttcaaatacgacggggctgcttgaccgtttggaaaaatcaagtttcattacacgcgctccgtcagaagaagaccgccgttcagtcgtcgttcaattaacggaaaatgcaaaagatattttccgcagcctttatcaaaaaggacatgtaaaattgaagcgttcattggaaacgctgaccgctgaagaaaaacaaacggtcaatcaagggctcgccattttggcaagagcgcttggatcttccaatcaggcatagagatgaaaaaggcctgccggtatcggcggcctttttttgtttgacatttaattcattcaaagtgaataatatattcaaagtgaattaaaaatggaaggattgatcaatatgccggagccattgcaaacagaaaaaaaccagagctgggccatcaccctctttacgatcggtgtgttcatggcggcgctggacaacggaattatttccgctgctctgacgacgattaacagctcttttgatgtttccccttcatggggctcgtggggagtaaccctttacacattgggactcagtgtcagtgtgccgattgtcggcaagctgtctgaccggtacgggcggaaaaagctgtttatgattgaagtcgggttgttcggcctcggctctttgcttgtcgcactcagtcaaagcttcccgatgtttttggcggcaaggctcattcaggcgcttggcggcggagggatttttattatcggcagttcgcatgtcttggctgtgctaccgaaggagaaacagggaaaagctctcgggcttttaggagcgatgaacggtatggcggccgtcctcggaccgaatatcggaagctttttgcttgatgtaaccgggtcgtggcattggctgtttttgattaatctgccgattgccgccgctttggttgtgtgcggcggtttgtttatcactgaaacgaaagagcctgaggtgaaaaagcttgatctcttcggcacgatgatgctgtcttttgcgatcttatcctgcatgatcggtattacgaacctcgatggggcgaagctgtcagaaagcataatggacgtaaaggtgtacgggtatctgttgggggcgggacttctctttgccgcgctgcttaaagtcgaaaagcgggttgaaaaccgcgggggtgatccgattctcgcctgctcgctgctgcagaataaagtgtttcaatggacgctcgtcatcggatttttatcaggcgggctgctcgctgcggtgatttttattccttcttacgcggagcagtatttgcacgtatcggcggaaaaagcaggttattggatgacgccgctcgctttggcgtcaggcatcggggcatggctcggcggggcggttacggataaaaaagggccggtcttctctgcggttgtatcaggcgccatcgcttttgccggattcagcctgtttccgttatgggtgacggataaatgggaatttgtcacggcgagtgtgattgcggggaccggtttcggatttctgctcggagctccgctgaatgtgcttgtatcagaaacggcgggtcaaaacaaagggacagcgctcggcacgctgtcactcgtgaggcaggtcgggctgacgctcgctccggccttatatgccggcttcattacagccggctttgaccggatcggagatgacatcaaaaaccgtttagcgaaaagcggcattcccgctgatcaggcgcaaatgcccgatatcggcggcggactttcttcgttgcaggaacaggtaagccgaatccccgtccccgccgtcaaaaaagcggtttctgatgcgattgaagcgggcgttgccagcggctaccaccatctttatacggcagccgccgtcatttcgttatgcacgattgtgtctgcggctgttttggcgtatttccggaagccggcatcctctaagaaaaatgccagtccatccgccgggaaagctcagtaatatgggcgatgtgatgttcagagtgccagacatataatccgagcgcctgttccagcgtaaccgtctccttagatacaggatggaaaaatgtccgtttgaattgagcttccgtcatggagcgcaaaagagcggcccaccttctgtgcaggatcgttaacagctcaagcgtatccccgcaagcggcggttttggaatcatggagatcggcccagcctttttcatcataaggacggatttccggttcatcctccgttaagctcaatttaaaccggatatagctgttcatgtggctgtccgccagatggtgaaccacttggcgcacagtccatcccccttcgcggtacggcgtatcgagctgactgtccgacatctctctgacagcttgtttcagtttggccggagcgtgttccagcgtattgatccattcttgtttctgtccggccgaaatcgattcaggcggctgatattctccaatcggatagctgagggtttgtgtttccatattgttcatctcccattgatcgtattaagaaagtatgatggtgatgtcgcagccttccgctttcgcttcacggaaaacctgaagcacactctcggcgccattttcagtcagctgcttgctttgttcaaactgcctccattccaaaacgagcgggtactccacccatccggtcagacaatcccataaagcgtccaggttttcaccgtagtattccggaagggcaagctcctttttcaatgtctggtggaggtcgctgatacttctgatttgttccccgttaatgactgcttttttcatgtgcggctcctttcttatgattttattctatcagtttaccatttttctcttcagaaatggccggattctgccccggtttcagctggacgatgtcctcctgtctcggacggctgcagattggatttgcccggctgcgctgcttttttaacagagctgatccatataaagaaggcggccgaaacgccgccttttttcagactgtgcggcccggggacgccgccgtgcttcttttgctgtgcttcggctgatacacttttccgacaaacaggtatccgtacctgaaatggttgcatccccacgatacgaaaatgggaccgagcgtgcagatcaaaaataacagcaggatggcagccggcaagggcattgaccgcagatagctttccaggaggtacccgctgattaaaaagtaggagtggagcagatagattgaaaacgaatagttgctgatcatcatcaccatcgcgggcactttattgagctttgaaaacagatgaaagcacagaaaaataatactgaccgcataaatcataatatccggacgcttagaagaaatggagccgccgctgacatatgaaacggccacaatcaatatcgccgatacggccgcactgaagtaaaccgcatagcggtactgattgatgagcgctaaaaaacgccggtattcctttccgcaataaaatgccagacagaaataaaacagccagcccggaaacggaacccaaaagaacggaaaaatagaatcaagccccgatgacgccggcggatgaagaattgaaaaatagccgagatagacggcattgatgataaaagaaacagacagcacccatgcgggagatgttttgttcagccagcggtgcagcagcatatggagaatgtaaaattgaaagatcacaagaatgaagtagccgataaagtttcccaaaaagacattttctaaaaatttacccatcactgaaacgaaaccggcgccttcttctgccacgcttttcattaaaatggcatccaccgcggcaataaacagaaacggcacgaaaatgacttttccccttttctttaagaaacccgcgggcacgccttccggataggacctggcaagcagaaattccgagataaagataaacgccggcgtgctgaacatcagcaaggtccggaacgcatcaaccgtatgggcggcgcttgctaaggactcttcctgaatcatcagcaccattgacatcacgtgcagcagaacgacacttaagcaggacaggcagcggatcacgaaaatttcttttatctgcatgcggccgctcctttttcacaagcacggcggactttggcgtacgcctggcgcagccgcttttcccgcagctcgggtgtgctcgttttgacggcggacataaagttccgttcggctttttgaatgccgcaaaattgcagaatgccttttttcagcgtaatccagtccgcgtttttccggaaccactttaagtgccggttcggggagtccgccgtataaaacacctgtgccgtctctgcccggagcagtccttttacacggccgttttcaaatgtgtaggcttctccggcgacaaacactttgtcaaaaaagcctttcagaatcgccggaacgcctccccaccacagcgggtaaatgaaaatgagatgatccgcttctttcatcagtttccggtatttctttgtttcagcgtcccggttcatatccctccgctttttttcatctccgaccttcagcacgggatcaaattgatcggcgtataagtcaatgacggtatagcttcgtccgctgtcctttaaagccatggcgacgtatttgacgatcgccgcattgaaactgttctcatccggatttgcatacacaatcaccgtcttcatatgtccctcccagtattttttaatttttacaatgattatatcattatgcagtatgaataaggcaaagacatgatgaaaggctttttcgccgactgaaacggcggccttcccttctgtctgtttccggcagcattttgattcgttttaaacaggattgaaatgcggtatccgacacttctgcgtttttaagcagccgtatggtatactagctgtcaaatgaatgggcttggaggacaacatgagaattttaaagtacgcgattttaggacttttgcgaaaaggcgaattgagcggatatgatatatcgagctattttaaagaagagctaggccagttttggagcgcaaagcacagccagatttatccggaattaaaaaagctgacggctgagggattcattacgttccgcactgcgattcagggaacgaagctggagaaaaaaatgtacacgctgactgacaatggagagcgggagctttgtgcatggctgacgaaaaaagatccgattccggaaacggtgaaggatgaatttatgctgaaggcttattttatctcagctttgacgaatgaagaagcggatgagctattcaccgatcagctcgtaaagcgaaaggagaagttgtccgatctggaaaacagttatcatgaactgatgacatcctccgaggaggcggattccttttcttctccggatttcggccattatctcgtgctgacaaaagcgctggagcgggaaaggaattatatttcctggcttgagcatattttggctctcatcaaaaaagcataaacaaaacggggcggctctgtatgcaagccgcctgtttacgttctgagacccgccgtaataaacgaatctgccattaaaataagaaaaagcagactgaaataaacaatcgagtaaaaaaacatccctttcgaccattgcgtgtcatccgctgctcgaaaacctttgacgctccggtacagccagatggctccgagcaggagagcggtcgcggtataaaacgggctgacatcgatataaagagggacgagcagcgaaaccgcagtcagaacggcgatatagcgcagcatttttatttttgtgacacgattgccttttataatcggcaaaagcggaattccggcagcacgatactcttcctttcgcctgattccgatcgcccaaaaatgcggcggctgccacaaaaacataatcgcatataacaacaccgccggcatatcaatgtacccggtcagggcgcaatagccgatcaagggcggagccgcccccggaaagctgccgacaaatgtgcccagacggattgtcttttaaaccaaagcgtataaacgacggcatacagcaaaaatgcaagcaggccgagaacggcggtcagtacatgaagcgaagcaagcatgatgaatccgcatgcgccgagacaggcgccgtataggatcataaccggcggcggtattttacccgtgacgcttgcacgggtgcgggttcgcgccatcttggcatccatgccgcggtcaaagaagttattaaaaacagtgcttgatgccatgacaagcgccgttccgatcatggcgatcgtcatagcggcaaatataccgggcccttcgcccgtcctttcagactgaagccatgcgatccaaaatccgcccaatgcggcgagtgaatttgagatgataattcccggtttggcaagaatgataaagtccttgaccgtcacccggtttccgttatgcttcatcggctgttccgtccgtgctgcatttgaattcatttgttcgggttctcctttttcggcttatcatatcaggaagaatcaggaatcacaattcattctgtatatttttcacacaattgtaaattatatataaaaagccgcatcttgaccggatgcggctcatttcctttactattcaaaatctgcccataaaactccctgatccggcttgaagcgagcagatcaatttcaaacacgggcattaagaaggctaatcccgtatcgtttttgttttcggggaagttttcaaataaaaaaccttgccattgatggcaaggtttttttcttacagtgtaaatgcgatatccgcccctgacacagggtctttgacgaatatgccatcgtttttttcttcaatttcaaagccggcatcagtcagcgcttttgtcacacgtgacagctcttcatgatgcggaagcacgatggtgtaataatccagcccgcttgcgtttcccggtttcggcggcgcgtgttttccggcccatatattcagaccgatgtgatggtgatatcctcccgctgaaacaaacagcgcggacatggccgcgtaattgccgacaatgtcaaaaccgagaatatcggtgtaaaaagccttggcttcctgtaaatccgtcacatggagatgaatgtgcccgataacggttccttccgggagacggcttttccgttcagctccggcttcttccaaaagcccgtccacatcgacgggcgccgtttgcatgacgtaattgccctctgcatcgcgctgccacgtgctgcggggacgatcggcgtatatttcaatgccgtttccgtccggatcagacaggtaaagagcctcactgaccgcgtgatccccctgaccgagcgcgatgccgttttcaatcagccgggccaatgcgatgccgagttctttccgatcaggcagaagaatcgcgaaatggtaaaggccggtgacagaccgctccggcagaatgacggcgcctggattttcttcaagcaccagcaggacgcgttttccgtctgctgacagttctgcggaacgatcggtttgcgagatgacttgaaagccgatcacattttgataaaagtcgagcgaccgctccatatttttgatggtcaatttgacataacccagtgccgtatcttgatgaatgccggtcatctgaacgccttctttcttatgctgaaaaagtttctcccttttttgatttgaaaaggagctgatccaatgaaagcagacggcttcctgaaagcgctaagtgaattgacgcaaccagcaagatgaaatcaaattccgatccgcccataaacggtgaggaaagcttcgccgtgaagatggcgccgactaatgtgatggcaaacagaacgccgataatgcgcgttgccaagccgaaaaagatcagaaccccgccaaccagttcaatcgttgcgatgacatagaccataaaggccggaatcccgatgctctggaaaaattgcgttgtgccttctaaaccttgaaacttggataaaccgtgaacaaaaaagataatacctgttacaactcttaaaagcagtgttcctgtttcgaatgatttattcataaaatcctccttgaaaattattatcacttactttatgtaagctagtatatatacataacttatttacgtcaagtaatttcgttacatttaacgaaaataacttaaaagtactagttatccccgcaaaaaaagacctccgcactctgtcggaggtctttgttcctatttatgattccctgaactggctttcatataattcccggtaaaaaccgttctggctgagaagttcggcatgggttcctttttcagccatttcgccgtctttcagcacaagaatctgatcggctttttgaatcgtattcagcctgtgagcgatgatgacgcttgttctgcccgccattaaacggccgagcgcttcttgtattttcacttccgtcaccgtatcaatgttgcttgtcgcttcatccaaaatgagcagaaccgggtcggccagcacagctctcgcaatggaaatgagctgtttttggccttggctgatgcccgcgccgttttgggtaagaacggtatcgtagcctttggggagccgttcaatgaatccgtgggcattggcggctttagcggcttcctccacctctaagtcagatgcatccaagcggccgtagcggatattttccctgatggtgccctgaaaaagaaatgaatcctgcaggacaaaccccatattttttctcagactggatctcgtcagttttttgatgtccgttccgtcgataagaattttcccttcattcggctcgtaaaagcgggcgatcagacttgtgacggttgttttacccgctccggtcgggccgacaaaggcgattgactgtccttgcggaacgctgaaggacagatgttttaagatcaggctgtcttcctgatagccgaaggagacatctcggaattcaatctctcccgttttgatcggctggtacagcgcatgctcttcgtcttcccgctcctctttttcatcaagcacgtcaaacacccgttcagccccggcgatggccgataacatcgtgttgaactgattggctaaatcattcagagggcgcgtgaactgccgtgagtattcggcgaatacgacgatggaaccgattgagatccaccctttcagcgcaaacagcccgccgaccgccgctataatcgtaaagcttaaattgtttaaagagttcattactttcggaatgaatcccgaaatggtctgcgcccaaaatcccgatgattttaacgccgcgtttttttctaaaaattgctccatgacgcggtcttccctcgagtaggctttaatgactttcgctcctgatatcgactcttcaataaaaccgttcagctcgccgaggtttttctgttgctgcttaaagagcagtcccgtccggctggtgatccatttaatgctcaaaaacatgatcggaataatcaagagcgtgatcaatgttaaaagcgggctcatgtacagcatgacggcgattgtgccgacgaatgtaatgacgctcgacagcacctgaatgactgatgtatttaaagtggagctgacattttcaatatcattggtgacccggctcatcaagtcgccgagccgctgtttatcaaaaaacggaatcggcagttcatgcagatgagtaaacagctcgctccgcattttaaacacggtgctttgagaaatattgatcatccaatagttttgaaaccataaggacaatgattgcacgaggtaaatcccaaacagtatgaacagcacccccgccaatccgtctgtcgtccgcccgacgatgaaatgatcaatcgctttcccgatgacgaacggtccgaggaggccaaatatggcgcttatgactaccatgatgatcacgagggacaaaagcccttttttctcggctacataagaccagatcctgcgcagcgtgccttttgtatcttttgctttcgcgcgttttctgccgccttcatttgatttgagcggtattttcggatatcggaaaggtttacgaatgtctttctgcactgtcagctccctcctttccgaattgtgattcataaatctgccggtacaaatgagactctgccatcagctcttggtgcgtgccttttgccagcagctcgccgtcttcaagcaataagatggtgtcagcctttatcgcggtcgttattttttgtgtaataatcagtgtcgtacattcataagacctgatcgcctttaaaagctttgcttccgtctgaagatccagcgcgctcgtactgtcatctaacagcaggagggacggctttctgataaaagcgcgcgcgatggaaatacgctgcttctgcccgcctgacaaattgacgccccgctgtcccagcaccgtgtcgtatccgtttgacagcttcataatggtttcatggatttgcgcgtctttggccgcttccattacttcatctagtgaagcatcctcccgcccccatgcgatattttcacggattgtgcctgaaaacaggagtacttcctgcggaacatagccgatttccctgcgcagtccatgagcggagaattcactgatcggtttgccgtcaatgaaaatactgcccgaatcagccgtgtacaggcgcggaatcagctgaaagagcgttgattttcctgagcccgtcgcgcccataatggcaaccgtctctttcggattggcagaaaaggaaacgtgatgcagcgcgtctttttccatgcccggatagcggaaggacacttcgcgaaactcaacgccgccttcaagcgtctgtgccgggtcgtgccccgtcccctcgccgccttctgtttccagcacctcgccgattctttctccggaagctttcgcccgggaaaataccatgataagaaaaggaaggacggacagcgcgcctgtaatccgcgtcgcatagttaatgacggaaacgacatcgccgacctgcgctccggcctgatcaatgcttttggcgccgaaccataagataaataaaatgcaaatgttcatcaacagcattaagatcggcatcgccgcttccacgagccgaaaagcggagactgtcttttccatcagcttcgtatttgattgcaaaaaacgtttcacttcgtggtttgcacggaggagcgctttaatcagtttgatcgccgtcaggttttcctgcatgatcgtgttgacctgatcgagccgcttttgtacagatcgaaacagcgcgccgcctcttttcagcacccacagtaaaaacaaaagtaaaatcggcaccgtgaccagcagaaaaaacccgagtttcgcattgacggtcagcgagagaataataccgcccgcgatcattaacggcgcccggagcataaatcggagactcataaaaagcatattctggacctgcgtcacatcgtttgtcagcctagtgataaatgatgtggatgagaattgcgcaaacgtcgaataggagaaggattgaattttttgaaaaagtccttttcgcgtatcatacgcatagctctggctgatatgggcggagtagaaagaatttaaaatgcccgaggcgaatgaaacaacggtcagtccgatcatcacgccgccccacagccagaccgttccgagctcctgcttcaaaattccttcgtcaatgattttcccgatcagcaggggctgtatcagctctaccgcaagctcgatgagcatgaaaaacagagcgatccccgccaacagagaatacggttttacatatgataaagcctttgacatgtgtaagcctccaaattctttgttcagttgtatgtatatttattttatttgtttgtcgtaaatgaataaaggattaacccttgaacccgcacttttattatgtactttatgaagaaaaaacggaaatcattgaagaccaaaattgaagaataagggatgcagatatatggaggctgtcttttctttttaccagctttctgaaccggagccttgattttaaaatgaattagcggagcctttaaaaaggcgtccgctagtcatttatgctttgtcatttcatttaacgaataaaaacgagagcgaccccgaatcctttatcagcatcaaactctttgatcactttcatgacctgccagcgctggtctggagaatcggattttgtggcaatcccattatgagcgtgaataaaatctcccgcttccacagtctcatcgcatctgacaaatacctgaccgataagcccgacaatgttccactcgtctctttcttgtcttgaagcgtagtcttcttcaggccgaaagtccggattttcttttggcgccatgaccgtatggccgtttgcatctttctgttcttcataaacatagccgccaaactcattctttacgtatcgtcccgaccagtgaaaactcgactcaccaagaattactccggcagtctcggaaataaccccaagcatgagatcacccttttcagccggtctgatcttatcaccttcaagtgtgacaagtgttcccgtcggaatcttctccccgctcaggctctcaaagtactcagcgtagtcagagaaggtcgaggaacctgttacgcctcccgaagccttaattgttccttcttttgcgtgaagctcaatttttctgtttgccgatgacggagtgctgccggcaccccagccccatacagttgagttagcttgtgggttaatcgtattatatgaaccgattaccccggattgagaaccacctgcagcctgtccccggacagaaccgacgacaaagccattagttcctgtaacgtgggaatctttagatgccataacagaagatcctttatgtttaaacaactcatacggtgtttttttaccgcctacattaaatgttgtttcatatccctgaaaatcaatatttgatatattcagatccggacccgaagaatagagtccgaccgttccgctgctggctcccaatctatgcccgtatacattgctcactgtgcaattatcaacgccgccgccaaaagcaagacccgtcgtgccgccgtcaactagaaaaacgccgtcaatcatgcactttcctaccgcattttctccgccgagaacataaagatcatgagcagcggagcggaacccgcggaccgtaatattcttcagattgacataccgtcctttgtaataaatcataatgatcgtgtcattgctgtaatcatatgatcgatcttcacaaatcgcctggaaattcactatattaactgaatcatagcccgaaacaaccaaagcactcgctccgacgcctttatatatagaattttgtttaggatttgttgcctggcaatttactaattgaacatcatgggcagtttttgatgtcggctcagtcgataaatggtggccaatatgtctaatacaaaaaccaatggcattttcgtaagcacggcaattagctagctgaacccgtttagctgccggtgcatagtcatgcgccttaatttcaaaaccgcgggcgccgccaattgcaacacagctatctacaaatacatcttgggaaccgtcatcgatctcaaagcaatttgaatttgacgtgccattcccatttcccatcgggtgataggaaatacaatgacaaaaagtagtatggtacccgaaatgacaagtaaagttatcatcgccggaccctgttgcttcacaatgagaaaacgttacaaagttacagccattgggctgataataagtcgggtcgtccatttctccatgtctgttatagttcgggcttgtagaatcaaagccgtgcaggccgccgttcttcgcaaacacatgttcgacaaaagaatagtccacattcgcaaaaagcagacagcttgaagtgggccctttcggaatcttccagccggcaggacgcgtatccttattccagtccagcgtgagatggccgacgtaaatattttcattaccgttcgtatagtcactgttggtcagaacagaacggccgacaggtgtttcgtctaataacttaatgaccgttcttttcttacctgctccgacaagcattgtatttgacggaacaaacaatcccgatgttctgaatacacctgcgggaacggttacgacataacctccgtcggccatcgcatcatgaaatgcttgcgtatcatctgttactccgtcacctttagccccaaaatccataacgtttcgctctgtaacgtgttcaaacctgttttcatacattttaagtctttcgtttaagttttcataagttgacgtgccatcgttaagggcggcaccgattttgctgtcaatcgcttcaaagttttgagcaatgctttcaacttcaacaccctcagttttatcaggtttgtaaagtcctaagaaagtcgtatagtttgtcattggtttgcctcctatttttaattgctaattaaaacaccgaacatcacagaagtcattcactcctgcatgtacaggtggcaaaggtatgacaaattcagacattttttcaacacacataaaaagagcgccggataaaccagcgctcttcccgttctgcacacagcctgctgctgcggtatgctaaccgttcagtattttctcaacacgctcccgcatttgcggcacgcctaatccgacgatgacctgaagcgccctgccttttctgacgacgccgtgggcgcccagctctctgaaatcggcatcacttttgacttttgaatcatcagcgacagtgacgcggagacgggtggcgcaattggtgacctccataatattgtcttttccgccaagcgcctcaatatacaaagcggctgtatcccgctgtgtttcgtctgccgccgctgtttcttttgaagcctgcttccgttctctgtactcctttttcgaatagagctttgtttcctgcccttcttctttttctctgcccggtgtggcgatgttgaatttgagaatgaggaaacggaagacgaaaaagtaaatggcggtaaagcacaatccgatgatgatctggtatacatacgtcatgccgtggcttgacgccagcgggatccagtttaaggtcgccgtttcaatcaagccgccgcccatatttccgacgacgccggccatatacatgacggttgccatagaagcggcaagcaaagcgtgaaccgcaaataaaaacggcgagataaaaaggaatgtaaattcaatcggctccgtaatcccggcgataatggatgtcaaggtgaccggaatcaacaggccggcgacgatttttttcttttcctttgaagccgtggcgtaaaaggcgagcgcgattcccggaatgccgaagattttcgagttgccgtgaagtgcgaagcccccctgcgggaacaattctttcagcggtttgacgctttgggagtattctccgagatgctgcgcccaataggtgacgataccgccttcagccacagccggaccgtaaacaaacggcgagtaaataaaatgatgcaggcccgtcggaattaagatccgctccaagaatgtgtaaatccacacgccgattgccccggaagaaacgagaaagctttgcagtgatccgattccggactgaaccatcggccatacgtatgccaccgcgagtgaaatcggtatcataatgaaaaaagaaataatgacgatgtacgaagatccttgaaaaattcccaggaaatccggcagttttttatcaaaataccgattgtgcaaataaacgacaatagatgaaataaagatggcgccgataatattcgtatcaagcgttttgatgccggcgatcatcgtcagcccgctcgttccgccgacttcctgattcatatcgacatgaaaagccccgccccaaaccgtcagaatcgcattgataaagtaattgaatgtcagatatactgtaagcgcttccaaacaagcccgcgcctgcgcttttttcgctaaagcgacaggtatgccgatcgcaaacaggagcggcatttgattaaagacggtccagccgccctgttcaatgacgtaccagcattgataccaaagcccgtcaggatcacccagcggccccatcagtgttttatttttaaagagcgtactcagaccgacaataatgccggaaaatgcaaataacaaaacaggcacaaacatcgcgctgccgaagcgctggactttttgcatcatttcatgtgacctcccgctatttatcaaaattttcaagctcttcataatcaacatatgcacggaataacgcttcgcccaccagaaaaaacggggcaaatgcgacgatttccgttttatcgcttaacgtcaccggcttgctggtcgcataaaggttatacggcgttgtttgcgccagtacgttgtttttcagattggtgattgaaataaacggaactccctttgcggacagggtccttacctgcggaattaattcgggtgtttccccggataaagaaatgatgatgaatacgtcatcgaccttaaaatcgtcacacatgatatcaaactctgtgatgtcctgaattaaaatcagatacttccgccgggatacaaacatccgctgcagctcacgggcgcacaccctctgagccgtgcccgatccgtaaacgaaaatccgttttgcttcatctatcagccggcacatctccgtcatatcttttgacttcacgtattttacgttggcttcaatatcatccagaagcttttcaaacgtcatattctcgccctcttcaggctgatcctcccatttcagaaaaacccggaattcactgtagccgctgaagccgagtttttgggccagccgcaggatggaagaccgagagacattgcaggctttcgccatatcattgataccgagatggtagcacgtatgcttattgttcaatatatattttaaaatataaaaatcgttgtcatttaatttcgcgtaatgctgattaaccagttcttcaagactcattccaaaatccccccgttttctttctattatatagaataacagatgaagaaaacggggaagattgtcatcaggaaatatgcgacggacttacgtcaagctcaggccagtagtctttattagcctccatcagatcttcaaggatcagtcttgccacacgggcattcggcactgtttttgacaggatcagcgcctgccacagcttttgaaatgaccgttcttcccaagcttcaaccgtcagtttttcgacagataactgctgctccatcaggcctttttgaaattgcggaatgttcccgactgagagcggttccggtccgtttgaacctacgagacaaggaatctcaaccatggctgatgaatcaaagtttgcgatcgcgccgttattttcaacgattaacagcattctctccccggtgttgtaagcgatggcccgggcaaggtcgacgatataggaagcatgatcgtcaattttaatttcactgttttccgacgactgttcacgtgtaatcatgtcacattggctgaagatgaaagcttcgcgcccttccatgacttcgttggctctcgtatgattcggatttgattttttcaccatatcatccgggaataagtaatattgcagatacgtgttcggaagcgtatccggatcggccgcctgaacatcgcgcgcttttttgaatgtgtcattccagcttgcttcagtctgctctgcctctgtcttcggaacgtagccatattcacggacatgctctttcagcttcggcattaaatcattgccgtgctgatctgtaatggaagtccaccagccgaagtggttcaagccgtaatagcggacgttcatttcttttcgggaagataatccgaggatgttcgccatgcgatcctcaattccgaccggcatgtcgcagatgttcaatatttttgaattcggtctgaggcgccgtgtagcctcagccacaatcgccgccggattggagtaattcagcatccatgcgtcaggcgagtacgtttccatataatcaagaatttccagaacgccgccgatagaccgcatgccgtatgcaattccgcccggcccgcatgtttcctgtccgaccacgccatacttcagcgggatttgttcatcaagcgcgcgcatcgcatatttcccgacgcggatatgcgccatgacgaaatcaacatccgtaaaagccgtctctgggtcatcagtcgccaaaaattcaatgtccggcgctttttcttttaagaatacctcacacgcacccgcaatccgctcctgcctttctttatcattgtcataaagtttcagctttctgatcggaaactcttccaggtgattcaaaagcattaatacaattccgggggtaaatgtgctgccgccgcctgcaataacgattgagaatgatttgtctgtcatgtgaagccctcctctgataacgtttacattttatttatatcatgagaacggcttctctgtaccgggtttgggggagttagatcatttaatcatttttagttatttttctcaaaaagcgggaaagttctcacaggaacataaaaggtctgctttgatcagcagaccttttctcaaaaatgctcttgtaaatcagaaagcagcacttcctgctcaaattgaggatttccgaccggaaaaatcctggctgtttctttgtcttcgttgacatgctgaatataaatcgggactccttcatacgtcacatacgccatggcggcggattcagcaatgtctttcgcacgctgtgtattcacgtctcaaacctcctttgggcctcacacataacgtgtccggcagccaagagaagtatgcttgtttcttacaattgtccggcggtgagtttgaattttttgaggcgtttgtaaaacgtgctacgcggaatccccgcaattttggcggcctgcgtgacatttcccttcgccgattcaagcgcgtttacgatcatgtttttctgaatgtgctcccgtatagagacaggaggcgcttcttcttgttcaaaaggctgggccgcctctttaagacctgacgcttcaagcagggatgcgaggggacgtccggacagccgtccgtccgggaacatgacggaaagacgttcaaacacattaaacaattctctgatattccccggccatttccagccctttaatatgtctaaaaagtcatcaggaagctctcccggccacctgctgtttcgctgaaattcaaagaagaggccgggaatgtcttcagtgcgttctcttaatggcggaagatgaatcggacagacgtgaagccggtaaaataaatcttctctcagctttttgctttcgacaagctgtctcagatcagtgtgtgcggcggtgatgattctgatgtcgatgggaatttcttttgtcccgccgaccggggtgactttccgttcctgcagcacccgtaacaaagccacttgcatggaatgtgatatttctccgatttcatcgaggaaaagcgtgcctttatcggctttttgcaaagcgccgatctgtcctttccgtttcgctccggtgaaggcgccttccatatagccgaacagttcgctttcaatcagcttttcggggaccgctccgcagttgacggcgataaacgggccgttctttctggagctgttgttatgaatcgcccgggcggcaacctcctttcccgtgccggtttcccctgtcagacagacggttgcgtccgttcgggcgacaagcttcagctgctgcagcatatttcgggatgaccggcttttgcctgcggcaccatgaaatataaaagccggcttttcttcccgtttggttacataaaagcatgtgaagccgttctcctcccgtttcgcctgcttgatttgaaagccctgttcctcaagctcacgcagcatatgtccggtaaaatgctgaacgggggggcttgcggcgataatccggttgatttcattacaaagcacgattggctcacgagaccgggtaagcccggcgaatttgctgatcatgtcaagctctgtcatcttcatctttaaggcaagctcccgttccgccgtataggcgatggaggaagcaattccgagcataaaaggctgagcgcgggaggcggggcaggaaatatcaatgacacccgccagccgcccgtcttcataacggatcggcgcggcggaacagctccattgatgggaagcgagcgaataatgttcagaaccgtgtaccatgaccggctcatttgtataaagagccgtaccgatcgcattcgtgccgaccgccttttctgtccagcaggcgccttttaagaaattgatgcggttcgcttcatgaatggtgcgcgggtggccgtcaactgaatggacaacgccgtcggcatcaatcaggagaaccatcatttccatttcccgcatcgccgttttcattttttctgcatacggtgccgaggccgctaagaataacgcatgcttctcggcctgcctttctaaatgatctgccggcatcacattcggccccttttcaagataaggattgacatcagcttttttgcagcggtgccatgaggcggccacccgcttctgaatacaggattcatcaagcacgccttctttcacaaagcgcttccaggttttaaaatcattccgaatgacattcattgtattcgctcccccctgttcagaccatcttttcatatattgtaggggaaaagtaaagcgctttcaacgaaaaataccccttctcagtcctgagaaagggtatcccggctatacggaatgcacagcgaggccggtgacattcagaagggcttcctgaagcgtttccgaaagagtcggatgcgcggtgataaagtgctccgacatatccgccgtcatttcgccgttcatcagcatgaccgcctgcccgatcaattccgtcacgtcaggcccgatcattgacaccccgacaatttctccgaattccggttcggcgatgattttcattttgcctccatgctgatgtttaattaatgccttgccgttagcggaaaatgaacattctccgatttttacatctccgtatttctctctcgcctgtatttccgtcagcccgacagcggccatttccggagatgtataaatacagcggggcaccgcccgcatattggctttgctgtcctttcccgtggcatgcgaagcggcggtgattccttcatgaatcgcggcatgcgccagctgcattcctccggccgcgtcgccgcacgcgtatatatgcgaaacatttgtctgcatatggtcattgacttcaatgccgcgcggagaataaaggatgccggcctgctccagattcagctcttgcaaacgcggctttctgccgattgcgaccagaatgtgatcagcctgcgcctcaatttcttttccgtcttttgtccacacggcggtttttctttccctgtcaatccgctggaaggaagctttcgtctgaatatcaactccgctgtctcgtaaagagtcttcaaaagcggccgcgatatcttcgtcttctgccgggagcagcctgtcagccgattcaatcatcgtcactttcgttttaaaacggctgaataaagaggcaaactcacagccgatcacacctccgccgacaatgagaagggaggacggaatctgctgtaaagaaaggacatctttgctgtcgatcacccaatcgccgtcaaagggggcaaaaggcagccccgcgggttcagaccctgatgcgatcaatatccggccggcttccagaatttctttttcgcctccttccccttcaatcagcaaagtttgatctgagagaaatgaagcagtgccgctgatgactctaattttatttgctttcattaagtattgaatgccctgcacgagccggttgacgatttgccgtttgcgcccctgcatccgggcccaattgagcgtaatgttttgcggaagttcgatgccgaatgtatttgcgtgcctgattttatcaagcacattcgcgctttccaacagcgactttgtcgggatgcacccctcattgagacacgtgcccccgagcggccctttgtctatcagaacgacttctgctcccctccgcgcggcagccacggcagctgcatatccggcaggccctcctccgataatggctagtgtcaatctcttcacccctctctataaaatcaatccggccggctcttcaagcagcgctttaaccgttttcaggaagtccgcagccggagcaccgtcacatactctgtgatcaaaggtgaggctcagcggcagcacggtgcttttgacaagctcatctcctttgaacgccggcgtttcatagcttgcgcccactccgagaataccggcttcaggcggattaaggatcggggtgaaatgttcaattccatatcccccgagatttgtaatagaaaaagtcgacccgtgaagatcatctccggaagcatttccttcccgcgcccggcgtgcagatgtgctgatttgatccgcaagctcaaggaatgaaagcttttccgcatcacggatcaccggcacgacaaggccgttttcaagagaaactgccatcccgagatggacatgcggataggtaatgatccgctcctcttgataagagctgttcagctcaggatgctgtttcagcgcaagcaccgcggcccgggatacaaaatgcgtgaccgtcagtttaacaccgctccgctttttcgcactgtcggccagctgtttctgccatttcacaagctccgtaatgtccgctttcatggtcagtgtcagctgggcgctgttttgcaggcttttgtgcattcggtctgcaatcacttttctcattgctgaggccggttttccctccggctgtgccgtctgaaccgaagaccgcggttcagcttccgtcttcatcgcctttatgacgtcggcttttacgattctgcccccgggccccgtcccgttcagcgtatcaactttcaatcctgccttctccgccatttttcgggccacaggggatattttcacgcggtgtttacgctctttcccggctttgggagcgggaatagtttcaggttctgcttgtggttccccggcattttcaggggccggtgcctccttctcctgcaccttttcaccgttttccccgatataacagatggccgttcccggcggaactccttctccctctttgactttaatgtgaaggagcgtgccgctttcgggcgcttctacttccatttctattttttcagagttgatgctggcgatgctttctcccttttcaaccggatcgccgactttcttattccagactgatacttcaccttgcttcatcgccattcccaatttcggcattactacttttacagccatactatatccctcctttaattcattgccggctcgccaagcaattcaagcgtgacgctgacaatttgatctgatgtcggcaaatattgatcttcaagcactggcgaaaacggtactggtgtatgcggcgctgtaattcgtttaatcggcgcatcaagcaaatcaaagcccttgtcggcgacaatcgctgcaatatccgtagcgatgctgcagcgcggattggcttcgtcaatgatgatcagccggtttgttttttctaacgatgtgaaaatcgcttcctcatccaaaggagacagacttcggggatcaagcacctcagcctcgatgcctttctcagaaagctgtgcggccgcttcaagcgcggtattgacctgtttgccgattgcaaacagcgtgatgtcgccgccttcacgtttgatatccgcttttccgagcgggattgtataatatccttccggcacctcgcctttcatgctgtaggacgttttgtcttcaaaaaagaataccggatcattgtcttctattgccgccagcagcaggcctttggcgtcatacggattggacggaacaactgtcttcagacccgggatgctggtgaaaaggccatacagcgcctgtgaatgctgggcagctgcccggaacccagctccgtatgtggtgcggacggtaatcggcacttgcgcttttccgccgaacatatagcggaatttcgccccttggttgatcacctggtcaaagcacgtgccgataaaatcattaaacatcagctccgcaatcggtctcagcccggttgatgccgcagccatagccgcacccatgtagcccgcctcggaaatcggtgtgtccagcactcggctgcgtccgaattcctgtacgagcccctttgtgacccccagtacaccgccccatgcttcatcatcctgtaaatgatcgacagccgctcccccggcgacatcctcaccgattaaaagcacattttcgtctcttctcatcgcaagcttcattgcttcattgatcgcgtctgacatgcttatgactctcgccatctcacattcctcctttttcatatgacacgtagacgtctgtcaacagctctgactctttcggatatggactgtcttcactgaacgagacggctttttcaatcgattcgctgacacgctgttcgatgtcggacagtttattggcatctgtttcttttaaaagatagtttttaaagccttgaatcgcatccttttctttaatatgctcagtcctttcatcctttgttttataggtttgggcatctccttcgaaatggccgtagtttctgtaggtcatacattcaatcaaagacgggccaccgccgtttcttgctctttctatcgcttcctcggctgcctggtaaactgctaaaatatcttttccgtccaccttgacccccggcatgttataggcagccgcccgatcagcgattgaatcacaggctgacgcgtactcaaatgttgtggcttcgccgtagccgttgttttcggcaacaaatacgacaggaaggttccatactgccgctaagttcagcccttcatggaaggtgccttggttatttgctccgtctccaaaaaagcaaacgcttacattgttagtctgtttatatttagcggtgagcgctgagccgcatgcgagcgtaaatccgcccccgacgattccatttgcccctagcatccctttattgagatcggcaatgtgcattgaaccgccctttcctttacacagtccggtcgctttcccgaatatttccgccatcatgccatccagatcacagcctttggcgatacaatggccatgtcccctgtgcgtgcttgtaatactgtcgccatcatgtaaatgagcgcacacccctacagctaccgcttcctcaccggcatacaaatggacgaatccgggaagcactccctgtgcgaacagttcatgaactttgtcttcaaagcccctgatttccagcatcttttggtacatccacagcgctttttcctcagttaatgacaagccttctcgttttaacaattccattttttgtgcgcctccttctatttagggttcacattaataaatgcaaaaagtgtgccagctttttgagcccgtaaaatcaatggttttgtttttacactgtgagacagtttgagacaggtgtctcattttgtctcgatctgatccacctgtctcgttttaaggcacacaaaaagaccggacatcacccggtctttgacaatgatcgacgtatttatttcctcggaaatgttttaatcgcttcattcttctgcaccttttgtctgaatggctgttttcagaagaaaatcaattgatatttgacataaccgaaactgccgcccccgtccttctgcatacagtctatcgtgccgtttgcgtatgcatttgctgtgctacagttcttgcttttcttcaactgcccgattcagcgcttgaagcatgtagccaatccctttgtacgaggacagaggccagctgagatgctgatgttctccgatgacggcgtttaggacgcttcggtattttttcccgccaagcatgataagctcttttgtattagaaaagcccttttcataaaattggcggcgcagctcctccgctgtcatgatctccggatggcctgttccaaaagtaacatcgtaattttcgggaacggtatcatcaggacgaaggaatccatgcttcgccgacaaaatcacccactcatcgaaaaatgctttcgcataccgctcgcacgcctgatgaaacgggctgagataagcgtcttccgcccttatcggccctgtatccggatggatgtcccatatttttttcttgccgcatgggatgatgcatagtcgtttcatgtttctctcccttgtgttgtttctcatatcaatgtaccactatccgcttatttctgcatgactaataatcagggtgcaggcggggtaaaggctgcacacaaaaagacccggaattcgtattgaaatccgggccgaatgagaaattgtttatatcactgctgctccatcccatcaagatactttctctcaaagtcatcgagcaatgcacgcacttcatctgttgactttgtgttcatgcattgatttcttaattcacttgctcctcgaaatccgcggagataaatcttgaaaaagcgaggaagaggtttgtatggacgtgcttctaattttgaatatttatcgtgaagatccagatgcagccttaaaagatcaagcaattccttactgctatgctctctcggctccttttcaaaggcgaatggatttgtaaaaatacctcgtccgatcataatcccatcaacaccgtattgttcggcaagttttaagccggtttcccggtcaggaatgtccccattgatcgtcaaaagggtatctggcgctatctcgtcacgaaggttcttgatttccgggatcagctcccaatgcgcatctactttactcatttccgctctggtacgaagatgaatggaaagattggcaatatcctgcttcaatacgtgtgtcagccagccgcgccattcgtctacatccgtgtagccaagtctggtcttcacacttaccggcagtcctcccgctttcgctgcttgtattaattcggctgcaacttcaggacggcagatcaggccgcttccctttccgttccccgccacattaggtacgggacagcccatattgatatccaggcctttaaaccctaattccgccatcccaatgctcatttgacgaaagttttcaggcttgtctccccatatgtgggcaaccatcggctgttcatcctccgtgaaagtcaaacggccgcggacactatcccttccatccggatgacaatagctttctgagtttgtaaactcagtaaaaaacacatcaggcctgcctgcttcacttacgacatggcggaaaacaacatccgtcacatcttccattggtgccagcacaaaaaatggccgtggcaattcacgccagaaattatctatcataataattcatatcctttcattagagactacggctgtatcatgtattccaaaattaaaaaactgaccatgctttccttttacacttatagcacgcgaaagcatttcttatcaaacgatagtaaattttgaacatttcactttttacaagttaaaaagtgaaaaagctaactgaaatagaacagatctaatagaacaccttcattgagttaatgtaatagagtgtcactataaacacagtcaactccttaaccttataataggttcgagagcgaaaaaagtgtgatgattatctacacgtattttttatttatattgtggtttattaatactagcgctgatcttcctctttcttagcagccttacttttaaactttttggataaaaagtattccaacccaaatagaatatcatatgagttctccctattaccaattcaaaataattatcctgttatcgaagagaaaatatttaacactgcaccatatccgtatctcaatatcatttgcggaaaaactaatttcaagagctatttgattaagcaaattgagtttggggtagtatatctgatactcaagagaatgtaaaaagaaaaagccctaacttgccgcttgtgaatcacatggagtaaagaggatgagatgagatgggaagagaaaataaactcgaacttaaaagaattcaagaacttcaatctggatcatttgggatttggcttatggtttagaaataaccaacgaacaagcggcaacctgacaaagattgcttttttctggcctatacagtatatgtactaagggtcgattggctttcaatggtttcgattcggtaatcctgatccagagccaataaaatagactgctgactaagtgtcgcagtcttcattcataagattaataagaaagtgttcattttctttcataattaaataaggcatcagaagttattgctttaatttcgaatatcctttgttataccggtgattatttgtataacagtgaaaacccctaagaaaacagtgacaatattaaaccatggattttcatagaatgaaagatatttttgaaagaaatccagttcaactatgtttgctgggaagccattcatttctctatacttaggaccccatcccgttaattctacaaaattaaaataaagctgtgaaactaaaaatgccaaaaccgtttgaaaccaacttcttttatataacggtcgttttttgtttactttatccatttaattatcagtttccttttctgcaatacttttttagccaagtgtcaatctaaaatcattatattatgaagcatgattgtcgcaataattacttattaaggatataaccattgtaggtattactgtaatagttgttatcgttggtcccacttgcggttccacctcggcactattatttaattgttgtaatgctaatacgttattcataattaatcctccattcttcatttgataaatttaacatttgaatttagtcttacatataaataaagaactaagtcacccacttcattcattttccattgacaataaataagaagtatgggatagtgaaaagaatttatatgaaaactaaatttattccttttttagaaacaggaaaaggattggggtccttttcctgtttaggctttcatataatgtatgaagaccaagcgtacttttttagtgtgtttggtcttttatccgcagttattgctaatagtagatgtgccaactaccgttgtgattagtgtaagtaagccacctttgccttttgaagcttctacttcagttccttcattcagttgttgaagttccaatacatctctcattcaatttcacctcctttttattatttattacaactattgctaatagtagatgtatcgatgagtgttgtcaagaagtgtccacccagctgtttctacttcagcactagaaatatgcagaaaatctttttttgttatgtttggtcttttattagcagttgttgctaatagtagatgtgccaactaccgttgtgattagtgtaagtaagccgcctttgccttttgaagcttctacttcagttccttcatttagttgttgaagttccaatacatctctcattcaatttcacctcctttttattatttattacagctattgctattagtagatgtatcgatgagcgttgtcagaagtgcccacccagctgtttctacttcagcactcgcagaaaatctttttttgttatgtttggtcttttatccgcagttgttgctaatagtagatgtgccaactaccgttgtgattagtgtaagtaagccgcctttgccttttgaagcttctacttcagttccttcactcagttgttgaagttccaatacatctctcattcaatttcacctcctttttattatttattacagctattgctaatagtagatgtaccgatgagtgttgttagaagtgtccacccagctgtttctacttctgaacctttactcaattgttgcaactctagtacttcattcatttgttcatccactcctcttaaatatcttaacagttgttgctaatagtagatgagccaactatcgttgtgattagtgtaagtaagccacctttgccttttgaagcttctacttcagttccttcattcagttgttgaagttccaatacatctttcatttagtttcacctcctttcaagtactctttcttagattatccttctctctcattagcaatgattactaagggtagataatgtaactgaaatagttgttagagtaacagtccatgccgtaggctccacttcagatttttcatcaaattgttgaagtaccagcacctctttcattttcttttctcacctcccttcataagttctgtatattaactgctttaattctaatcttcaatgattatcatcgaatataagtgttagagttttaattgtttaataacaattctttttttgtctttcttaagaaactatcaatttttattattggcaaccaatataacggatttgaaaactggatagagtttatgcccaatattatgccagcacttccggagtagtaatcatctgctaaacgaaagctgaagtttccagggaataatacttgatcatctttgcggataagaaacaattctagttttctcaatgccagctcaatatgctgactgatttcatttttttccttagtcattggcgggattaacaagaaactaccgatcccatcaaacaatccaccgctatatgcgatccttactttatttaaattgattatttgctctaattcttctctaaataaattattattttttacataatttaaataccaaatagcaattcctattccgattgatcccccagataaatagggtaataatcgagggttttgatcatcatatgtttgcaaagtattcgtctcttcatctaccttacaatgttttaaatctcgctcaatatattcttttgattttaaataatatttttcattcttagtaactgaatataatgccgcatagaataaagatattcctgaccaaccatcaatcaaacctataggtactgctgcaaaatcagtcactgataatttatcatcttcaataatccttttttctatctgatcagcaattttttcagaagtaaccaaaaaatcattattattttcttccatgtataagctaattaatgaaagacctattcccgacaatcctgaccttaatgaaatatctttcatatcttcatatgacagattattgaataagtccatagcttgctctatgtatcccaattcatacaatgttgctgcgataccagctcgtcctgtaaataacccaacatcatcattaagaacattcaatttttcaagtaaaacattttcaatccaatcccaaacttccttgctgacgtttccagatctgtacaatgccaatgcagctccagttcccccagttagtacatttaactttccagatggcattacaaattgccgtacatcgccatgaattagcgagctgttgggcaaaatattactctctatactgtttctcaatccttttattacttttgacatgtccatttctttttgtattttactgtcataactattcttgaatatcttttctttggtgtcagataagtatttgtcacatagattttctgtatttacaacatattgatagacatctttgccaaactcgtcctctatccacatatcatgtttctttttaatggtttcttctatatcagcaaccggacctattggcagaatacaaaatcttaaaactttctttagtgcataccaatcacgctctttatgattcttatttttcttatttgtgtagccaattgtttgcaacgctccgttttcttcagagagagcactagcagcctcaaaatcaataatcttaacatttgattcgggggttatcattatattttggggttgtaaatctcccataccaacatctttactatgcactagtttaattgttttgaccaagctattaattatttttttcaccttactaatgtattcatttttatcattttcaacgttgaacggataattgattgcacaccaggtttgaagagttacaccttctacaaactcttcaactaaaaatacatgtttccaagctttaaagtaatcaagtacattaacaacaccttcaacatctgtaagtttatttaatgcttcgtattctatattcaatctatcaatcgcatcattaaattgaccatctaaccctactttaggtcttccttctttgattactacttttttcccatccaatttccttattccagtatatataccgccaccattattaaacctaaggactccttggaactcataatcattaaaattacttacatcttgagtatctaataagttattcttggaatctaaatactgatcaaaatcacttacgaattcaggtattttataatacggctgtctattatccggaattaggtttccattttcgtctttaatacaaagttctcctctttcattgtaaatattcttaaacgcaccatatcggtaatatatattgctgtccttccacgatttatcatttagtatgtatggtccattctcataatgttttaattcttcataaagttcattcaataacctgaagaacatgttattagaggaaggatagatagcgataaattttccagatgaagttcgattaccatgcttcgaattcatattaaatagagattgtttatctttaatatgtttaaatggtatctgatgtttaaatataatttgactcacaacttctaatatatcctgagcattattcattgttgcacttacgtgtattttccagccttgttctttgagggtatgatttggattattataaaacttccatggtgatttgtattctgtactaacagtatagtaatttggtatattatgtacttcatatggatcagtctctgcatttgggcttttctctatatagtattttgaatcttcactcatgtgttggaaataaactaattttttgtccattttgttttcgcctctcttaagccgctcttaattggttaatactaatggatcggtactatcttctttaaactgctgctcacagaattgatgatacaatttatgactattctttaactcccaatgattcccttgacctgtgatctcaccgttttccataaaaatgatattgtcagcatttataatggtggataacctatgtgctattataatagcggttctatccttcataagcttcttcattgcttcgttcacaattcgttcagaatgactgtcaagacttgcagttgcttcatctaaaaagattatatttggattcttcagaaacattctcgcaatagcaattctttgtcgttgtcctcctgataagttcagacctttttctccaatattagtttctaaactgttaggcaattcacttataaattgccatgcatatgccttcttacatgcttctactattcttttttcatttgggggattttctaaaccaaagatgagattgtctctaatagtaccgcttattaaatcatgattctgtgctacatatcctatttggctacgccatgaatttaatgaaaataactcaatattctcgtcaccaaaataaatatttccgctgttgggcttgtagtatctctccagaatagagatgattgtggttttaccactaccactaggacctactaaggcattaacacttcctctttttattattaaattaatatttttcaaggaaaatgctttatcctcattactgtagcaaaatgataaattttcaatcactaaatctttattggtttccgctaattcttttcctttatgctgatcttctccttgctcatatatcaattgagaaattctttctgttgcacctattgtcttttgtatttgagtaaagaatagcccaaagttattaagtggacccatgatatagaacataagtgtcagaaatgctataaacgttcctggcgataaacttccattggctaatttaacccctccgaatccaattatgctaataatgataagcatcatcattaaattaatgatagggtttaaaataaccatccattttgtctgctttaggcctatgcttcttaaagcttcaacatcttcttttcctttttctacttgtaatttttctgcagttgaagatttaaccagtcttattgcagatattgtttcaacagctcttacatttaattcacctgttaagctttgcgtcattttagataatttagataaaattcttcctaaaggtataaaaattaataaataaactggaattgctacgacaatcactagtgtcaattgccaatcatagtaaaacaaccaaaatccacaaaaaagcactattaatatagcattgataaattgcgaaaaagagttacttactaagttgtaaatcaccgtagtatcattaacaaatctacttgctatatccgcagaacgattcttatcgtaaaattctacaggcagtataactatcttttcccataataaatttctgagatttgcgacaacattatatcctactacacttaacatataactaccaactgccccaattactccgctgcttaaaaatatccctagcagtcctaataggtcccacaaattgatcttttcatgaatattgtaatagtctattagactttttaaataatgaggcactaaggtagaagctattgcgcttaatccacttaaaaatattgccaatataaataatcttatattcggtctggttttactcagtaagaagaaaaactctttcgatttaaaattagggttggtcatcattttcacctctttcgtttaattccaatgtctcaactttttatatcgaatgactcttgaaatgacatacgccatatctttcctgattttcctataaacaatatttcacactcaataactgtaagtcaatatataattttacaaattataaaaaaacaggtctttggttatacattattctacttttgtatattacgaaatgtatattcactcttaatatttctgcccacaaaaccataggcgtagtataaaagaataaaaagaaatttaaattaatcatactaaagggacgtttccggggataatcacttctaattagaaaaatatgcattgactgatttacttatattttataaaattgaattaaatatacttatatttcattttttggaatgggagggtgaattatatacaatcttataatgaaatgtataaagagaaaggagtataaaaaatgaagaatttaagaagaatttcgatagttttcatatttgtaattgtatctagtttacaacctgttagctctcgtgctgaagaatcaaatcatgatgaatctatcataattaacctcgactcaaaaattagtgaatcgacaataaacaaggttcaggaaaagtattcaaatatagaaacaaattatattaaagaactagatttattggtaataaataatataaaaccaagccaattctcagcaatcaaagatattgctaaagaaaaattagacgcaaatgaaattattgaggataaagaaatttctcttcctgaaaaaagtaaacagattcctgctaaagtggcatcttcatcacaattcacggaagataatgacactctttatgacagttggttatggaatatcaagcaagttacaaatgattatcgaagttatcagataaataaaggatctcataatacaaaagtagggataatcgattcaggcatagatttcaatcatccagacctcaaaaaaaatattgtagatactggagagtcttttgttccagttgaagataatacacaagacttttatgggcatggaacttctgtggctggaataattgctgctaatggggatgtaaaaggagttggaccaaatcttggtttagtgccgtataaagtatttgataaagacggtaaatctaaaagaagttgggttataagcgcaattgttaaagctacggaagatgatatggacgtaattaatttaagtttatctacttttttatcaaaaaaagataaagatgatagagagactataaaactttttgaaaaagcttttaaattcgctagaaaacacaatactttaattgttgcagcagctggaaaccatggatatgatatctcaaattcaaaaaaacttgcacaacaattaggtaaaccaaaggacaatatcctacatcttcctggtggagataacgatgtaattactgtatctgccaccacagcgcaaaatacaaaagcttcttactcaaattatggaaaaaacatctcaattgcagccccaggtggtgatctggatacaaataagattgatctatatagcttggtatggactacttcccctgtcaatatcccgcaaactccgctaagtaagtcactaggctttcaaaagggatatgaacctactttagggacaagtgtagcagctccaatagtaactgctacagcagccctattaaagacagaatactacgaaaaatatggagaggaaatgccaaatcgtaaggttgaagaaaacttatatcagaacacagaccacgttgaaaacttagataagaatgaagtaggtagcggtatcgtaaatgcttacgaatcattgcttaatattgagagataaaagatattaagcagttctcgaacttcactaaaaatactttgattaataaaaaaagattactagacgataatgatgatgaagtagagatgaaataaattatatttacgggatattgagaataactaaataagttaagttcacaagcaacttaatattactaagttgcttgtgtcatattttatttcagcctgagtattcaattctttagctattgttgatttctttatcgcacaaaacccagcatgtagcagcaccttataaacagaccaattctttcccttgctttaatctatcttcaatagcccacttaccttccttaccctaaatccctctatacgattttgtgtacggactaaattttgattacggaaccatgaaccgactcataaagttctcctaaaatttaagggctcactctagttggttttctttctgtttgtaaaacaattcatactattattactccttctttagcagtcccaaacactctttatctctcttcccaatcaacagtgcttttctcttgttattcggctttattctcggtgttactttgtaataccattcccaatcatacttacaaaatccacgtatgcagcccttttgctgtcctacccaatccaacaattgtctcatcaaaatagggacagcgatacttgaagcaagtaatgtaaactaaaacaagtcgctccaataaatccaattatcagacctctttttatattgcttttcattcaaattcacccttaacaaaccatttcataatcatagtgaacaattagctaattaagcaaaatgtaacgatgccaactattattaatacatgaaaaaatgcacctgtcataggacagttgcaaaggccttactagaactagagcatcagcatgttgtctacgctaagccaaaaagtggttattacattgttgactattatcaaacccctagtccaattaaagatcatattgattttatctgctgatccggataaacgcattgccttatcggcactttaacattgtatgaatcaagcgatagatcattataaggagcaattattcacgtatagttagcaacaggggctttactctttaaaaaaggagtttacaaaatattcacaggagttacaagtattcacgagacttgaacgagtcgttattgctcttcatattttgtctgtaataccgtttccaaacgaaaaaaagaatatgtttatggagcagcatgatagaactttactgttgaatcatgttacagctttaggaattgatctaaaaaatgagggtttccgcacgttttttcagctcttttcgtcagtgaaaataaagttctctgagaaaagacagtcagggcaaaggctccctatgaaaaagacccggaaatcggcaaggttcattctgccgaaatccagatctgatcaggaatcgttttttaattagacgatttcaatacaagcttcgccacagcttccacatgagccgtctgcggaaacatatccacaggctgaatatattcgacgcgatagtccttcgacagcgcctgcaagtctttcgccagtgtggaaggattgcaggatacgtagacgaagcgtttcggttttacttttttgatggtatctaaaaatgttccgtcgcagcccgttctcggcgggtcgacgatgaccacgtctgggcggaagccttctttcgtccatttcgggagccagtgttcagctgttcctgtgacatatgccgcgtttttgatgccgtgttttttggcgttcttcttcgcatcgtcaattgattctttaatgacgtccatgccgcggatctctttcgccccgcttgagacccacatgccgatcgtaccgacgccgcaatatgcgtcaacgactttttcttttccggtcagctgcgccgcttttttcacttcgtcatacagcttgaccgtctgctcagggttgagctggaagaaagcgcgggcgcttaattcaaatgacacgtcaccaagtacctcttgaatggcatggcttccggccagcgcttttgttttgtccccgaaaatgacggatgtgcgcgcgccgttgatgttttgaataatcgatttcacttcgggcagacgattctgaatggctttgacgatctcgtctttattcggaagtgtctctttcgccgtgacaagcacgacctgcacttcgcctgtttcaaaaccgactctcgtcacgatggtgcggacatcgccttttttggtccgttcgttataaacagatacgttgtgtttttccaatatgcggcggacaatacccgttgttttgttcgtcgccggatgctggacaatgcattccttaatcggaacaattttatgggaatcaagtccgtataagccggcaatgatgctgccgctttgcgagcgtccgacttgaaactggcttttgttccggtaattccacgggttgtccattccgatcgtttctttaatgttcatttcttcaacattgaatctcgtatgacgttccaaagactgaatgacgatatcgcgcttttcgcgaagctgctgactgtaggccagatgctgaagctggcagccgccgcattgatcgtataccggacaaggcggcgtgacgcggtgttcagacggcttgcggatttttttgacgcgtgcttctgaaaatttcggctgaacgtttgtcgcttcggcaacgacttcttcgccgggcagagcgccgggaacgaagacaacctttttcttaaaatagccgacgccctctccattaatgccgaggcgtttgatggtcagcggaaatgtctgtccgattttcaattcggcaggcgcctttttttgatgttgattcacgttttattctctccgtttctataataaagccatcctcatgggaaaacggctgatttgaaatatcacatcttttcagtataacatgcagccggcggttccttcatgtttttcaccggaagtttccaaaaaatactcggaagcgatcaaatgccatcggtaagccatcttgtttttattcaatacttctccacaaatacaaggacgcgtagcttaaatacggcgcccattccctgcttacttgaagcatcaagtcttttgacggtttatcctcaagggcgaagcggcgtttgacggcgttttgcaggccgatatctgccaaaggaaacagattcgggcggccgaggccgaacatgaggacgttttggacggtccatggcccgatgcctctgatggtgatcagctttttcataatgtcttcatccgataactggggaagttccgcaagattgagcgctccgtctgcaatcatccgtgaaaggtcaatcgcatattccgcttttctcatgctgaactgaagctcccgcaagtcctgatactcaagcgccgcaatcgttttcggctcggggtagcaccagacgccgtctttttgttcgccgaaggcatggacgaaccgttccgttaaggtaaaagcgaaggacaggttgagctgctggtggatgatgcatttcatgagacagttgtacacatcgtattccagcacgagcggggttcccgcatgctcttcaaaaagcgcagacagatttgtttttgaaaaatgatcaagcacaggctgaagcggctgctcccactgaaaaatgtgtttgatccgttcaatcatctcctcgcggtccgtttcgccgctgacgaggaaaaccggatctatggcggtgcctttcgcttgaaccgtgatgaccgacagtttgccgtcccgtgttctgagcggaactttaattgaccttgctgtaagatcgaccgcattcagcggatcgagtgacagcctttcaagcactttatcaaaatgatacggcggcgtgaccgaaaccgtttcctcccacatatgctccacccctttttgtccaagtatatcacgaagcgttccgacggcaattcgtatacttttcttcataacgccgcatgatataatggcaggcggagggttgtttatgatacatataaccgcaatcacaacacataatgagatattagataatatccccctatcacgtacagaacaaccggacatcgcatggtactggattgattttttcggagccgagatgcatgaaaccgagctgctgcgggattatttccattttcatccgctcgcgattgaggattgctttcagcacatgcagcggccgaaaatcgaccattatgacggctaccgtttttatgtgctccacgccttgaacccggacacactggaaatggaagaggtggacatttttcagtccgaccgtttcatcgtcagcttccatctgcacgaatcgcccggcatctcgagagtaagagaacggtttttcgcttctccggggttagccaaaaaagggcccggacacataacgtatatgattatggatcagcttgtcgatgaatatttccctgtgctgtacaaaattgaagaccggctgaatgaaattgaagacagcagaacacataaatcttacggcactttaatgaatgaagtgtttgaattgcggactgatcttttgaacctgaggcggacgatcattccgatgcgcgatttaatgtaccggattttgagtcttgaccatgtaaaagaaagccgtgaaacaaaagcatatttcagcgatatttacgaccacctgttaaaactggctgagctgatcgagtcaaaccgtgatatgacgtcagatctgcgggacagctatgtaacactgaattcaaaccggatgaacgccatcatgatgacgttaaccatcgtctcgaccatttttattccgctcacgtttatcgcgggagtttacggcatgaatttcgataacatgcctgagcttcattggaaatacgggtattttatcgttttgggtgtaatggccgctcttgtggccgccatgctgttttggttcgcccgcaaaggctggtttaatattttcaagtaagaacggctgccggctgttcttttttttgtgaaaacatgatatgttggaaaaaaacgtaaagaggtgtgcgccgttaccattctttctcacaaaaccatttcttccgcccttctgcttctcagtgtcatgtccattgccccgctgtataacggctgtacgatgtctgattacatctttgagtggctcggcttttcttcttggtctgaagatggagcccatatctccgtcattcccggggtcgtgctatattttgcggcgttaatctggtgtgccgcctcgttcagacggacgcttcccgctgtggggctgtttctgatctttctcagcatgggggtctcttccagcatcagtcctgtcactgaatatgccgctttttccttaaaacagttcgcgcctgaaagaaaagctgtcgaatatctgaagcaccgcagtgaatgcagtcatctgattgagcgcaaaaaagcgagaatgagctgcacgatttatatcaattattatggaaaaggggaacaaaccatatctatcacacctgacctatctgagaacgtaaagggcgtcacattcaaatcaaaaacattcactgtaaagccccgatcgaaaacaatcatcaaggcgcagtttaccggcttttataaagggaaagccgcatcagacagcggatggtcttcagaacctgacctaaaagttgcaagcctgcacacagcagaataaacgttttgcatgtataatgatggaaaacatttcattggagggactgcaaatgaaaatcgccatcgtcggactcggcaatatgggccgccccatcgccgaaaatatcatgaaagccggatacagtctgactgtctataaccggacgaaagaaaaagcggctgatctgctggagaaaggggccgaatatgccaaaacgccccgtcaggcagctgaacatgcggacattgtgctgtcaatgctgtcagacgatgaagccgtaacaggtgtgactttcgggcctgacggcattattgccgggttatctgaaaaaggcattcatatttcaatgagcaccatcagcacggcgctgtcagaacagctttccgctgcgcattcgagcagaggacagtcctttattgccgctcccgtcctcggccgtcccgatgcggctgagaaggccgagctccgcatcatcacagccggccctcaggaagcgaagaaaaaggccgaaccgctgtttaaaagcctgggtcagcaagtatttgacaccggtgaagagaccaaaacagccaacgcggccaaaatcagcatcaatttcttgctcgtttctatgctggaggcgttatctgaatcattcttaatgatggagaagtacggcttgggccaaaaacaatttttagaaatcgccaacgcgctctttggctctcccgtctatcaaaattacggaaccatcatgtccgagcagaaattcgaaccggccggtttcaaaatgtctttaggcctgaaggataccaatctggcgcttgccgccgcagaacaggttgccgcaaagctccctcttgccgagctggccaagagccattttgaaagcgggatcgaacaaggcttcgggggtctggattgggccgctttgattaaatgcctgaaataacaaaacacctctccaatagcaggagaggtgttttttacaagcgcggcagcttcatttctttctcaaacataaggtcatcaatgcttttaaacgtgtatccttctttttttaaatcggtaatcgcatcgtccaaagcttctgaattgtcctttgaaacggtgtggagaaggtagatcgcgccgggatgcgcctgcttgatcatgtgatcgtaggcgtattttttccctttctgctccttaaccttccaatcgacaaatgcgacggaccagaaaacggtttgatatccgaggcgcttcgtttctttcaagacatattcgctgaatacgccgcgcggcggacggagatacaggttatcccgctttccggtgatgttgtaaacagcttccgtgacggaatcgagttcgtcctgaatctgatcacccgtttttgtcgtcagatcaggatggtgaaaagaatgattgccgataatatggccttcctttgacatccgcttaatcaaatcaggctgctcttttacaaaatggcctgtgacaaaaaaagtgcccgtgacatgatgtttctttaacacatcaagcaccttcggggtgtatccattttcatatccgttatcaaacgttaaataaatggtcttttctttcgtattgcctaaataaaaggcatcatattttttgaccagattgtccagctgcttgccggcatccggcggctgatgattgacgcttcgtttaaatccccagtttatccgctcattcggcacggcctctgcgctgtttatgcctcccgcaagtaaaacggccatgcagcaaattgaacaaaaccatttcatgcccagcactccttctgcatttttccttattttgcagtaggctctccccttttatacagccgcattatggaaagagaaaaaccccggcagatgccggggtttattcccaatcctttttaaaccgttcgtattttgcttccagatcatcaagcatgccgatgagccggtctatatcttcaacgtccgttgattcagggtctaacgaatcaatgacattcataaacatatcgagtctgttcttcaagtaatcgagctgctgatctttgctgtttactgcattccccatacttccactccattcattttttataatggtagcgtattttttgccgtttttcaatggttccgctacttgcgatcttggcagatcaggtctaaaattaacagttggcagacgttagtatgcccatttataaaggagttagatagtcatgacacaaaacacagcactgcgtccgatcacaccggagtacgatccttgggaagcgtacatggatgtggaccagtatggagatatgaaactgacgaacgttgaattcacaacgacgaccttgtgcaatatgagatgcgagcattgcgccgtgggatacacgcttcagccgaaagacccgaatgcgctgccgctcgaccttttattaaagcggctcgaagaaattcctctgttacgctccatcagcattacgggcggcgaaccgatgctttctctgaaatcggtaaaggaatatgtcgtcccgcttttgaaatatgcgcatgaacgcggtgtgcgcacacagatcaattcaaacctgacgcttgatatcgggcgctatgaacggattattccttatttggacgtccttcacatttcccacaactggggaacggtcgaggactttgccgacatcggatttgcgatgatggagaagaaaccgacatttgaacagcgggcgcgctattttgacaaaatgattgaaaacagccgcacgctggtggaggcaggcgtcatggtttcggcggagacgatgctgaacaagcgcacgctgccgcatatcgaacatattcaccggcagattacggaagaaatgaaatgtcagcggcacgaagtccatccgatgtatccgagtgatttcgccagcgcgctggaatcactgagcctgaaagacatgagacaggccattcatcatctgctcgatattcgtgatgaagagacatggatgctgttcggcacgctgccgttttacgcatgcagccctgatgaagaagaccagaagctgctccgccgcctgcgggaagcgaaaaacgttacggtgcgaaacgaccctgacggccgctcacgcctgaatgtcaacatttttgacggaaatatcattgtcacggatttcggcgatacaccgccgctcggcaatattaaaacagacagccttcctgaagcgtatgacaggtggagacagacgaagctgagcaaagagctgaactgccgctgctcaaacgtccggtgcctcggcccgaacgttcttgtcaaaaacagttattatcaggagacagatttttcattacgcaaagccagaggttaacagaagatggaaacgacaattacagatattttgaaaagcaaagtggttgagatcatcatcgtcgctctcgtgctttacgtcggtgtttttctgatcaaccgctttgtacagatgttatttaaacgcactgatttcttggaggaacggaaaggaaagacaatcgaaagcctcgtccggtccatcacccagtatacggcgacgatcggttttatcttttacgttatttcattatttgttcatgatttcggccgaattttagccggggcgggcgttgccggtatcgtcatcggtttcggagcccagtctttaatcaaggacattttggccggtgtatttttaatatacgaacgccagctgcataaaggcgattacgtgacgattaataatctgttcaacggcacagtcgaagaaatcggactccgttctttgcagatccgtgagttctccggcaagctgcttaccatttcaaatggtgaggtcagacagcttcagaactataacattgattttatgcggattaccgaatctgtcgtgatcagctataaggaagaccctgaacgggtatatgccatcttagaaaaagcctgtgacatgctcaatgatgaacttcgcgattcactgaaacgggatgaatttctcaatgcaacggagccgtttcaagtgcatggaatcatgagcctgaacaaattgacgagaggcattgaatttacggttaaaggcatggttcaagacacagaatacttctcggcaagccttgcggtgaggcgcgttcttgcccgcgagctgtacaacaacaatgtgcaattgcttgaggagatgtatcacacacaaaaaagctgattcccaaaccggaatcagctttttcatttatctcggctgcgctgtaatttgaaagccgaatgtgacatgatcctgcaccggaatccaagcgccgattccttgcgaggtcacatttttgacgacaagtttccgcttgctgcctttcagcaccaaatacacttcgccgtatgttacttttcctttttcattaacggccggggcataggcgtgtaaatagccgagccgctgcggagaaattttataagtttgatcgcgttttgtgcctgcgccgatgactgtttcaaatgcaagcggcagttttgttttcttcatcgctttttgcatcatcatgcttttcacatcttctgcgttcggcacttttgctgtgagcccgcctttgattttgtattgctgttcttgtgcgtatgaaatttccgcggcttgctgcccgccccggttatccgctctgtttgtgttgatttttttatattcccagttggcgaccgtttcgttcgactgatagccgagcgcccatttcccgagaaatattttcgcccggtatccgatggcgagcggcgaaccggaaaccgtggtttcattcagcattttaatcagatgcgggttttcgatgttgatctctgatgtatctaacaattcctttgccagtttgctcggctgaagcatcggctggtcctgtgaagcattcggatacgtattttcctttgaaatgcttacgacagagttgggaaccttaaacggtttctttgcaccggcagacggcgttgcgaaaaaactaaaagataacagcagaatcagtgtggcatgaaacagctttctcatcatatcactctttctatagcattttcctttagtcttttcctccgcaatcgttgttatccgcatttttttacaggttaaagcaggaaaaatccgatcgccataatgacataggccgcaaggagcgtagccccttcaaaccagttcgaatcaccgtcatttgaaatcatcgtcatcaaaaggacggatgatatcattgcgacaagctcaggcaatgtgaatacaagcggcatattgaccgggaaaaagacggaacagatgacaagcaccggggccacaaacatggcgatctgcaaagtcgatccgaccgcgatttcaacggcgacatccattttgtctttgtacgccataatgatggcggacgcatgttctgcggcatttccgacgattgcgacgataatcactccgataaacagctcgctccagccgaactgttcagccaccgcatgaaacgtatggacgagattttcagatatgtaggcgacgataatggtggcgataaataagacggcagtcgctctcttcccagaccactcaggctgctcctcttcttccttggcctccggctggttcggctgataaacaccgcggtgagtgacgagcttgaaataaagagccgccacgtacaaaaggatcatgatgatgctgatgccgacacttaaatcaagcttgcttttttcccccatatccatggaaaacacttcgggaatgacaaaagctacgataatggcaaatatcagcaggcctgaattatgccgggcatcatgaatattgaattcctgccgcttgtatttcaaaccgccgataaaaaacgacaaccccgcgacgagcagaagattgccgagcaccgaaccggtcagtgaagcaagcacgatgcccgtcagcccttcctttaaggcaaaaagcgatataatcagctctaccgcatttccgaacgtggcgttcagcaggccgccgatccgcggacccgcgataatggcaagagattcagtcgctctccccatataacttgcaagcgcaataatcgtcaaacaataaataataaacaaaacagctgacggccagtgtatcaggcttccgataactgaaagcggcacccccgccgcagccgtaaagaaaaaaatccgattcatactcagcctggctcctttttcgaatgagtcttttttatccttctcaaaaactccctcaattacacttccgtagaaacccaaattggcattttcaggttgccggacgcgaaaaatccgtgtacgatcaagacagatactgaagaaggagaaaatacgcgatgtcacgactgcacttctttattttggttctgcttgtttccatctccggtttttcccaaggcatgcttttgccggtgatttccgtcatttttgaaacgaacggagaatcagccgccataaacggccttcacgcaaccggcctgtatatcggcgtgcttctcgcgtcgccgtttatggaagcgccgctgagaaagctcggatacaaaccactgatggtaacgggcggatttcttgtcatcatcagcttattcagttttatttggcttcaatccatatggatatggttttttcttcggctgcttatcggaatcggcgaccatatgcttcatttttcaacccaaacgtgggtgacttcaaagtcaacgcctcaaaacagaggaagaaacatttcgctgtacgggctgtccttcgggcttggattcgctgtcggtccgttcatggttcctcttgtgaaaacaagtccgtcccttccgtttattgtatccggctgtatcagtcttgccgcctggctgtttgtgtttttcttacgtaatgagcacccgccgcaaggtccggatgaaacagccggggacaacagcgcaaaacgtttctaccgcgccattcttttcggctgggtcgcttttcttccggctttcggctatggctttttagaaacggcgctgaacggaagcttccccgtgtacgccctgcgcttaggcatatccgttgatgccgtcgcgctgatattgcccgctttcgccatcggaagtattgtattccagtttccgcttggtttattaagcgatcggttcggtagaaaacgtgtcctgctcgtcattttactgacgggcgccctgtgtttttcgacggccggattgtttccgtcgcctgccgttatcggcggctgctttttcatggcggggatggcggtcggcagtatgttttccctcggtatcagctatatgagcgacctgctgccgtcccatctgcttccggcgggcaatctgctctgcggcatttccttcagcctcggcagcatgatcgggccggtggcgggcggctggtatatgcagcggtttgaaagcgccaatttgttttattttattacggtgatcctcatctgtatttggcttgcgctcgtcttcggaaaaacaaagcacagccctgcatctgaatcccattctttcccggtctcataaaaaaagccgcctgttccatgccaggcggcttctttctagtggtatccgttctgcccgttcgcgcttccgcttgttttattcttcgggccgttttttgagttttgtttattatggcttccgccttttttcgtatgcttggtcataatcggtttccctccgttttcagcttgaacgtcatccgttcctctatagcttgctcccgcggtagggattttcatcaggaagctttttacgtttatgtaaaagcgcgttgatttctcctcctaaaatcagcagggttcccgtcaggtaaaaccagatcataaggacgataattcccccgatgctcccgtatgtggcgctgtagttggcaaaagtgccgacgtaaaatgagaacagcatactgacgataatccagccggctgccgcaaacacggctcccggcagcacaaagcggagagaaagccttttattcggcgcgaaaatgtaaagcgcggtaaacacgattaaaaggattagcggactgataccccagcggacaaccgaccacacctgcaaaaacaggccgggggcgccgataaaatctgcggccagcagcccgatttctctgccgaacaccggcagaagcagtgcgattaaaatcgtaaccaccatcgcgatggttaaaaaaattgaggtcaggcgaatgatgataaatgagcggttttcttcgacttcgtaggcatggttaaatgctctgacaatcgcattcataccgttggaagccgaccagatgacggcgataatcccgaatgacaaaagcccgccgctgcgtttgttcagcgtttgctccgtaatggatttcaccatggacatggcgctgtcgggcgcatattgatcgactgcgccgagcacgtcttctgccgatatgggaagataggcggtgagcgtcagtatgaaaatgattaacggaaacaatgacagcagaaaaaaatacgccagctccgccgatttactttgtccttcatgcagagaaaaccttgcaaacagctccttcataaaactcatgacatcccacctcaatgatcgtttttcgaaaaatgctccttcgtttcttttaacagctcaatgacctgcggtgttgtctgcttcagcttggagatctgattgtttaaaaaactcagatcgtctgatacggtattggccatgattttcacttgatccatttttgcagaagcctcctgtttcagggcttcaggatttttccggtaaaatgcagcacgctgcctgcacgcgtccatattccggaaacatgcctctcttgtcggcttatgtaataatgacagtgctccgccggcggcagcgccgatcagaattgcttttgccatgaagcgtgtctgtttcatcggtcaatcccccttataaatgatggtctttcttaattgtgtccagcaaatgatggcaccccgactcgatcaacgcgtacacctcgctgaaattcccggtatagtacggatcgggcacgtccgcaagatccgactccggtacataatcaagcagccttgcgatacgcggcgccgcttttttataaccggccatgctgcgcagatgtccgatattttcagcatccattgcaatgacgtaatcgaaatcggtcagatcagactcacggacctgccttgccgtgatgccgcttgtgctgattcctttctcctttagaatctcctctgtcccttcatgcggcggatttcccgcatgccaggcgccgattcccgctgaatcaatgttaatctgattttccagcccgtttttctttaccatatcagaaaataccgcctctgccataggcgaccggaaaatatttcccagacagacaaacagaacatgtaccatatcgtaacctccctattctttccccatattttgaggatcaaaaaccttatcatcatcttagcaacttttctgcggctgtggaaatatgcttttattctaaatgaattctgttagaataaaggatacgaaaacggtcatgaaaggatgcatgaatttgccgagccaacaaacagaaacgttaaacaagatgattgaagacatttcgcagaagctcaatatgctcaatgtcggcgtcatcaaagcggaagatttcagtgatgaaaaaatagaagatcttacatatcttcatcaaatggtcatgaaaaaggaatcattcagcccgagtgaaatgcaggccattgcccaggagctcgcctctctcagaaaataaacccatgtcagacctgccgaaaacggcgggtctttttgaattaaaaaagtgaaaaataaaagttcatcggtttgacacatataaaaagaaggagtatagtaactgtgaacttggtagaacgatatactaaatgagcgggccgcttatatttttttatttagtagaacgatatacttgattggtatcagcgttacgcgagtatatccgtttgtctctgcagccgttttatcaaaccagttttcagagaaaggcagtggttcaataaaggggaatggttctaggcttttatcagtttaaaaaataaattaattctttattaaccgcattaggggatgtcatcatgaaaaacatatacaccaaaatggcagcgggtctttatatcaactatttcctgctgggcatgatcaatattattatcgcatccaatatggaggcattatcaaaacagcttcatacatcagcagccggagtcagctatttggtctccgccatcggaatcgggaagctgatttcgcttctgtttgccggaaagctctcggatacattcgggagacggccgtttatcgtggcgggcgcatttctgtatctgattttcttaatcggaattccgctttcgacaagctatacggccgcgtttatcttcgccattttcgcagggatcgcaaattcctttttggattccgggacatatcctgctcttattgaaggatttccgaaaaacgcaagctctgcaaccgtgttaatcaaagcgtttgtatccatcggcgcgacggtgctgccgttttttatcgcatttattgcggacaggcatttgttttacggctggacttttttcgtgccgggcatcattttcttcctgaacggctttttcctgctgaaggtgccgtttccgaatcataagcaaaaagacgacggcggcctgacggaagcctttccgccggatgacacgttcaaatcacagccgtcgatatggcgcgaaggacttgccattattttgttaggcttttcatctacggcgctgtttatgctcgttcaagtatggcttcctaagttcggacaatccgttttgggcatgccggaggtgcaagccgttaagttgcttagctattacagcatcggggcgcttgtgtctgtgttattgttggccgtgctgttaaacagagtgattcagccgattacggtaatggtgctgtacccggtgatcgcggcaatcgcgctgcttgctttgattttcattcatcagccggccgtatcggtcatcagctcctttgtcatcggtctttcaactgcgggtattctgcaattggcgatgacggttatggctgttttattccctaaaaataaaggtaccatcacatcttttgttaatatagcatcaagcttatcttttattgtcattccgcttgtaacgggagcgatatccaaagcggccggcctgacccctgtttttctgctagatatcggaattgcggctgtcagcgcacttctcgcattgtttatcggaatccgctttaagcaagtgatgaaagcctgactattttttaagggagaggatttatcatgcatactattacaatcaaaaacacggttatcggcgaaggccttccgaagatcattgtgccgctgatggcagccggagagaaagagcttcttgaagaaatggaagccgttaataagcttcacccggatatcattgagtggcgggcggatgtttacgagcatgttgacagcctggacgccgtaaaagacatgcttgaaaaattgcggaaagccgcaggcgaaacaccgctgcttttcaccttcagaagccataaagaaggcggaaataaagtcattgacggccgcttttacattgaattgctcaaaaccgcaatcgaaacaaaacacattgaccttatagacgttgaattgtttacaggcgatgccgaggtcaaatcaattgtaaaaaccgctgaagaaaacggcgtatatgtcatcatgtccaatcatgattttcatcagacaccgaaaaaagaggaaatcatttcccggctgcgcaaaatgcaggcgtatggcgcgcatattccgaaaatcgcggtgatgccgcaaagcactgaagatgttttcgtcttattggatgccacacacacgatgaaaacacaattcgcagaccggccgatcatcacgatgtccatggcaggcacgggcctgatcagccgcctggccggcgaagtcttcggctcggcatgcacgttcggcgcgggcaaagaagcatcagcgcccggacagattcccgttgatgaattgcgcagtgtactcagcattttaaataaaaatatgtaatcagcgtttttcttcccccgagcgggatgaaaaacagatgaatggactaacggaggaatacatcatgaagaaagatttaggacggattaacggaaaaactcagcttatcggattattcgcgacaccgatcggacattctttatctccggcgatgcacaacctggcgtttaaaaaattagggctgaactacgcttacctcgcgtttgaagtcggcaatgaacagcttgaagacgtggtaacgggaatgcgcgccttaaacgtcagaggcttcaatgtttcgatgccgaacaagatgaaaattctcccttacctcgatgaactcgcggattcagcgaaattcaccggtgcagttaatacagtggttaatgaaaacggcacattgatcggacactccactgacggtatgggatacgtccgcaacttaaaagaacacggcatcgatatcacaggcaaaaaaatgacgcttgtcggttccggcggggctgccactccgattgcgattcaatccgcattggaaggtctcggcgaaatctcaattttcgcccgcaatgacgcgtttttcgaaaaagcggaagaaaatgtccgcatcatcaatgaagaaatgaaaggctcttcttgtaaagcgaatatcttcccgctagaagatcaagatgcgctgcgtgctgaaatcgccacaagcgatattttcacaaacggaacgggtgtcggcatgaaaccgcttgaaggcttgagcgtcattgaagacacatccatgctccgtccggatttgattgtgacagacgtcgtttacaaccccgttacgtcgaaattgctcgaacaggcacaagaggccggctgcaaaaccattaacggcctcggcatgatgctttggcagggcgccatggcgtttgaatactggacaggccgtgaaatgccggttcagtatattaaagagcaaatgtttgaataacctattgtaacaaaagcgccgaaggacaatccgtcttccggcgctttatcattttctccccctctccctttcttctcatgcgccaaaacgcttataatggttgtaacaataaaaaccaagtgaggaatgcacgtatgaaacagcaaaaaaaacgccgggtgacattgcagcaggtcgctgagcatgccggcgtctcaacatcgaccgcctcattaatcgtccgcaataatccgcgaatttccgaagcgacccgtgaaaaagtgctgcaatccatgcgggaactggggtacgtgtatgatcgggtcgccgcgaatttacgatcacagacgtctacaacggtaggactgattattactgacatttccaatacgtttttctcagaatttctgatcggcgttcagaatacgctcgaggaagtcggattaacggtgctgttaggcacgacatttgattctgtcgcgaagcaggagcagctgatctcgactatgctggaacacagggtcggcggattgattttatgtccggtttcaggcgcggccgaggaaaccctttcccgccttgaacagcttgacattccggtcgtgctcgccgtcagggaaatcgccgatgccgactgtgattttgtcggagccgattatgaagaaggcacctataaggcagtgcatcatctcattgaaaaaggccatcaggagattgcgtttctgggcggcgtgaagcactcatctacatggacaaaacggatgaaaggtttaaaaaaagcgctccgtgaggccgatcttgaagtgaaaaatgaatttgtcattgacagtgcaccgacccgcgaggcaggctatgaagcagtgatggagctgctccgccggcctgagcgcccgaccgcgattttctgcttcagtgatttggtcgcgttcggtgtcatgcaagggatcagaaaagccgggctcatcccgggcgaagatattgatattgtcggttttgataacgtgccggaagctgaaatttcttatcccccgctcacaaccgtttcttcctttccgcggcagtcgggaaaagaagcggctcaattgctgcatgataaaatcgccagttcccagcacaaaaaacagcgcattattctggcgcctgagctggtcattcgggaatcttcatcaaaaaagcggaacgcctgatacggcgctccgcttttatattacgcaagcagttttaatgattcgcggttgaatgccggaatgtcatccggagtgcggcttgtgaccagctggttctggcagacgacgacttcttcatccactacatttgcgcctgcgttttccatgtcaatacggatcgatgtaaaccctgtcgctttgcgcccgtccaatgctttcgcgttgatgagaagctgagggccgtggcaaatggcgaaaacaggttttttatcatccataaacgctttggcaaattggacgaaacggtcatccgctcgcagcatgtcaggtgagaatccgcccgggatcagcaatgcatcaaagtctttcggattcacatcatcgatggacgcatccactttcacttccgcttccccttgtttgccttttactgtttttcctttttcctgttcaatcactgttaattcatgacctgcatctttaaaagctttcgcaggttcagtatactcgacatcctcgaaataatccgttaatacaactgcaatttttttacccatagttactacctcctgctttgatgaagtctacataaatccatgaccccagccagactaatatcaaacatgggagacacgtttgccgcccatccgtattacataggtcattatcctcatttttcatctttttacaagaatcatcatgaaatctatataaactttcacaaaatattcttacaatggtactgcatgacaaaatttgttgaaaggtggagaacaggtgagaatacagaaaagacgatgcagcgtcaatatgacactccgtattctgctgcccctagttatgatacttagtctaatcctcccaacatcacccattaaagcagaagaaaacaaatcctccagtgtgaatctcagcattttagcgacaactgacgttcacgctaacatgatggattacgattactacagcgacaaaccgacaacggaattcgggctggcccgaacggctcagcttattgagaagcacaggcgcgaaaacccgaatacgctgcttgtcgataacggagacctgatccaggggaatcctctcggtgaatacgcagtaaaatatgagaaaaatgatattatctcaggtgcaaagacccatccgatcattcaagtaatgaatagtctgcactatgattcaggaacgctgggcaatcatgaatttaattacgggcttgaatttctggacgggacgatcaaaggcgccgaatatccgatcgtcaacgccaatgtaaaaacattaagcggcgaaaaccgctatacgccttatgtcataaaagagaaaaccgttacagatgaaaacggcggaaagcatcagataaaagtcggctacatcggctttgttcctccccaaatcatgacgtgggataagaaaaatcttgagggccgcattcaggtcgaagacattgtggaatccgcaaagaaaaccattccgaagatgaaagctgaaggagccgatattgtcatcgccctcgcccacagcggcatcgaaaagaaagcgcagtcttccggcgcggaaaatgccgtttttgatctggcaacaaaagtcagcggaattgacgccatcgtatccgggcatcagcacgggctgttccctgatgccgaatacaaaggcgctgatcaattcgacgtcgataaaggcacgattaacggcatccccgttgtcatgtccagcagctggggcaaatatgctggcgtcatcgacctccggctccagaaaacagacggcgcgtggcatgtggaagatgcaaaaggcagcatcgagccgattgccggaaatgtgacttcggaaaacgaaaccgtcgtcaataccgtcaaaaaagcgcatgaaggcacgctcaaatatatcagagaacctgtcggccagacaaaagccgatatcaacagtttcttcgcccaagtcaaagatgatccgtccattcaaatcgtaacggatgcgcaaaaatggtacgccgaaaataagatgaaggatacgaaatataaagatctgcctatcctctctgcgggcgctccgtttaaagccggggggcggaacggttcaaactactatacaaacatttccgcaggtgacctcgccatcaaaaatatcggcgatttatacttgtatgacaacacggttcagatcgtcaagctgaacggaagcgaagtgaaagactggctcgaaatgtccgcggggcagtttaatcagatcgaccaggcaaaaggcggcagccaagccctcataaatgacgcctaccgctcatacaatttcgatgtcattgacggcgtcacctatcaggtcgatgtcacaaaaccggcgaaatacaatgaaaacggaacagtcattcatcccgacgcaagccggatcgtcaacctttcttatcaagggaagcccgtcagcgccaagcaggaatttcttatcgtcacaaataattaccgcgcttcaggaggcggagggttccctcacttaagcaatgataaaatcgtatattcatcagccgatgaaaacagacaggtcttaatggactacatcatccagcagaaaacgattaatccgcaggctgatcataactggtccatccttccggtcaaagggacgaacctgacatttgaatcctccttggccgcaaagccgtttgccgaccgtgcagatgacgttgcctatatcggagaatccaaaaacgctggctacggacagtacaagctccagttcaaggatgatgaaccgggcacagatccgccgaaagatgatccgtggaagctcaccgttatgcatacaaacgacacgcacgcccaccttgataacgcggcgaggcggatgacgaaaattaaagaaatcagaagcgaaaccgacagcagcattttgcttgatgcgggagacgtcttctcaggcgatctctatttcacaaagtggcagggactggcggatttaaaattgatgaacagcatgggctacgacgcaatgaccttcggaaaccatgagtttgataaaggaccgggtgctctcgccagcttcctgagcggtaacggaagcgcggttgatccgtccggaaaatatcatttccaagcgcctgattttccgctcgtcagcgcgaacgttgatgtgtccaaagaatcaaagctcagtccattcatcaaaaaagcagacacgtttacggcaggaaaaaagaaaaaagcaggcatctatccatacattctgcttaatgtaaacggagaaaaagtcgccgtattcggcttaacgacagaagatacgtccgtcacatcaagcccgggaaaaagcatagtctttaacgatgccttccaatcggcgcaagatacggtaaaagagatacagaacaaagaacacgtcaataaaattatcgctctgacccatatcgggcatcagcgcgatctcgatctcgccaaaaaagtaaaaggcatcgacttaatcgtcggcggacatacgcatacgcttgtagataaaatggagatagtcaaaaacgaagagccgaccatcgtcgcacaagcaaaagaatacggtgaatacctaggccgggttgatgtcgcatttgacaaaaacggcgtcgtcctgccgaaacaatcctctcttcaggcgctgcctgtgaacgagcagacgaaagaagacccggatctgaaagaagagcttgatccgtttaaaaaagagctcatctcagtcaaaaatgaaaaagtcggctcaacgaaggtcgcacttgacggccagcgtgagcatgtccgctccaaagaaacgaatctcgggaacttcatcgcagacggcatgcttcaaaaagcgaaggaagcggccggcgcccaacttgcgattacaaacgggggcggcatccgcgcaggcattgataaaggagacatcacactcggtgatgtactgaatgtgatgccgttcggcaacacgctttacgtcgcggatttaaccggaaaacagatcaaacaagccctggaacaagggttaagcggaattgaggctcaaggcggcgccttccctcaagttgccggcttgacatacacgtttacactgaataaaaaaccgggacaccgcgttcttcaagccgcggccgtgcaggatgacggcagcttaaagccgatttctgatatggaaacatacagagtcgccacaagtaactttgtcggtgaaggcggagacggatattccgtctttaacgaagcatcacataaagaagaccttggctttgtcgactatgaggtcttcatagaacagcttgaaaaagcaggaaaagcggttgaaccgaaagttgacggccgcgcacaagaagtgtacctgccgacgaaacaaaaaaacggctcatggacccttgaagatgacagcgcatttgccgtctatgccaaaaacgccaacactccgatcgtgtattacgacaagaatgacggcgccaaaaagcagattgacctcagtgtgaccaaaaaacagatcggactgttaaaggacagaacaactgattcttcccttacgatcctgcatgacaagttcagcatgaaaatgccgatggcaaacgcagccgcagctgatacaaggttcggcgtatcgccgaaaggaaaagtaagcgggtcgctttcaaatgtgtacgattttacaatgaagcagaacaacaaagaagtaaaaacattcaaagcgccggtaaagctcaccctgcgcattgagaatacgaaaaaagcgaaacagccgggcatttatcatgtagaccggaaaaagcacgtctatacaaaaacagaaaacggttcggtttcacacgatctcgtcacgggctatacaaatcatttcagtgaatacaccatattaaacgcaaacacgaagagcgcgccgccggcaagcggagatcacggctcgggaaagcagccaaacggacaaaacccatcatccggccctgcgcaggacggagtatcgccgggcggcctgcttcctgatacggccacaactatgtataccattctccttgcagggtttctcatcagcgcgctcggaacggcactgtatctgtatcaaagaagaaaagcaaaaaaagtgaacgaagcataaaaaaaccgcttttatcgggcggttcggcacaagagctcccctgatctgatatcaggggagcttttctgtcggtccctttctgagtcgacagccgtatgtccgaatgataaaatatcgcacagacgtacaatctatggtatgacacttcatggcgggtctggctttcccggcgccgcctgtttggaggacttttattgaagataacaggaaagatacgaaacagcatgacttacaaaaaaaagctgttttacgcaataacagcactttgttttatcggctcgctcattttcgtcaattacaacgcttctttttatgagcgcccgattgccaaagtgacgaaaacaacattggagcatcaatctgacgtgcaggacatgcataaaaacaaagataggattttcaatcagaggatcacagccaaacttgaaaacggcagtcggaaaggacagctcattcatttgtccaatcaatattcatcctccggagcgaatgatcagaaatattcaatcggcgatgaagtattcgtttctattgataaaggaaacacgtcaaataaggatatatcgggaagcattatagataaaaaacgggataaacagcttttgctgatcgcttggattttcatattcaccttgcttatcgtcggtaaaaaacaaggcttcttttcgatcatcagcctgatctttaacgctgttttgctgtcgtttgcattagatttgtaccggaagcaccagaacatcgggctcattttcatctgcggtatctgtattctcatctttactgtcatatcattgctgcttgtcagcggctttcacgcgaaaacatatgcggccatagccgcgacgctcgcaggcacatttgtttccctgctgattacgtatcttgtgatgacggctgccggagagaaagggctcagatatgaagaaatgcagtatttaacccgcccttatcacacggtgtttatggctggggtattcatcggatcactgggagcggtcatggatgtggccattaccatgacgtcatctgtctttgggttatatgaagaaaacaagagtatctcattacaagcgcttaaacggtccgggatggagatcggaaaagacataatgggggcgatgaccaacattctgttttttgcttatataagcggctctattccgatgatgcttttgtatctgaaaaatgattcaccgataggattcactctttctatgaacatttccttggaaatagccagagcattggccggggggatcggaattgttttaaccatacctgccagtctgtatgcttctatctttttcattaaacgaaagaaggcaagctcatgaatgtcatcgtaattcttgcggcgattttatttctattgatggtcatgatcggcggtaaaaagggagcgagatcatttattgcgttatttttaaatttcggtgttctctttctcaccatcattttaatgacagacccgcatatcaatccgattgttttaacattgctctcttccgccgtgatttgcagcattacacttttttatattaacgggggaaacgtcaaaaccgtaaccgcctttatttctgcaatgctgacgattgtattgctgctgttttttattatggccgtaacgaaacatacttcgattcaaggatttggtgaagaagaactgggtgatatcggtatattcacgctttttgtcggggtggattttgtgaaggtgaccgctgcgatgatcattatgggcacgataggggcgattaccgatgtggcgatttccattacctcgcccatgagagaaattcacagccataatccgtccatgaacagaaaagatctgtacaaattcggtttaagcatcgggagagatattttaggaacgaatacgaatactttattctttgcttttttcggcagctatctggctttaattatatggtttaaagacttatcatactctgctgaaaaaatagtgaactcaaaagtcttcagcgcagaagccgtcaccattctttgcgccggaatcgggatcggcttgatcattcccgttacgtcctggatcaccgcctattttttagcgaaacaaaataaacgttaaaagctgccggcagtttcccggcagcttttttatcttatacccacttcacaacgtcttttgagacagatcttgttttcgggcgcggttctctgacacggtacccgaatgcggccatgacggagatgtcgaaacttccgtcttcaagaagcccttcttcttcaagaatccggtgaatttctttgtaattgaagccttctaccgggcaggaatcaatgccgatctgcgcagcggctgtcatcatattgccgagggcgatatatgtctgctttgatgcccagtcaaacagcgcacgatctgattcaagcagattgaaatcatgtttctggaattcttccgttttgctgatatagccttcatacatatcatccggcatttttttgacttcccgcaagtggtttttgacatagtcggcgtcaaaacggatatcctttgccgtccgggcaagcagaagaacgaaatggcttgcggtcggcagctgcttttgcgcgccccacgtgaactcgcgaagtttttcgcgaagctccggattttggacaacgacaaatctccaaggttcaagaccgagtgagcttggggataatcttcccgtttctaaaatgaattcaaaatcgctttctgaaatttttttctcaggatcaaattcctttgtggcgtgtctgaattgatacgcttcgatgatctcgtgttttttatctgacattctgatctctcctttacaatctcgtatgtactattgtagccaacatttttaaaagtaccagtacgcacatttttgttggatagtatccattttgatactgacaaaaaaacggactgccgcggcagtccgttcttatttttctcttctcgcaaagtcgacgaaacgaaatttatcgagcctgtgccggctttccgtatattgaaagaggctggtgtcctccaaaaacacacggtttttcacgaccgccatatggctgaatccgccgagatccaaatactttcggtcttcttcccctgccggctccacgacaatttctttttgcgcgtagctgattgacagaccgagctcttcttcgagatactcgtaaatcgaatcttcgcaaatcgccttcgtcaaaagaggaacgtgctttttcacaaagtaatccttgtccaaaataatgtgttctccgtcaatccgccttgatctgacgacttcccacaccttttcatccgcctttgtgccaagctcttttgcggcttcggcgggaggcggaatcagcccgagacggtgaaccgtcgttttcgtctcttttccgagcgtttccgaaagctccttaaagctgatcaggcctgagacgggaaaacgcattttttctctgtctaatatgacggagcctttgcctttgattttctggatgtagccgttttgcgccagcatattgagcgctttgcggacggtttctcttgatgcgccgtattgatcgcacaaatcattttcagacggaagaacgtcttccgccttccgcatgccgctttcgatttgctgcaccatgtctttatagattgtgatgtatttattcactttcattcatgaccacccagattagtgtatcacgctttggtcagatgataaacgatcgattcatacggacggagcgtcaatcgttccggccgcccttccctctgttcatcattcgtcaacagcaccgtaaaccgccagccggccatgtcttcaagcgggagcgtaaaatccgcttcttttccatagaagttgttgatgcacaggagtttttcatccttgccgtgtctcacgtacgccagaaccgacggatcgtcttcagcaagcagttcaaacgttccttcggtcacgatgtcatattcctttctgagccggatgagcttctgataatggtagaaaattgaatccgggtcccgcaaagccgcttctgcgttaatgtcctgataatcatccgccgcgggaatccaaggcgttcccgtcgtgaaaccgccgttcggttcgctgttccattgaacgggagtccttgaattgtctcttgatttctcttttaaaatggcgataatgtctttttcgggcacgccctcttccttcatcttcttgtaaatgttcagtgattcgacatcacggtatgagccgatgtcatcgaatttcggattgcccatgccgatctcctcgccttgataaatgtaaggcgttccctgcatcatatgaatcgccgacgccagcattttagctgatttcgtccggtacacgccgtcgtctccgtatctggatacgacccgcggctggtcgtggttgcaccagaataaagcattccagcccccgcctttttgcatctccgtctgccaaaacgctaaaatccgtttcagcttcagaaaatcaaacggagcgagcgcccacttttcaccattcggataatccacttttaaatgatgaaagttaaaggtcatatcgagttctttactttccgggtttgtgtaccggatgcagtgatcagccgttgtcgaggacatttcaccgaccgtcatgctgtcatatttcgaaaacacttcccggttcatctcatggagaaattcatgcacacgcggcccgtccgtataataaggacgcccgtcatgtccgtccttggcatcaggaaacgattggtctttagaaatgagattgatcacatcaagccggaagccgtcgatccctttttggaaccaaaaatgcatcatgtcgtaaacccgttttctcatctcttcattttcccagttcaaatcagcctgcgacacatcaaataaatgcagatagtgctggcctgacgccggatcgagcttccaagcggagccgccgaattttgattcccagttgttcggcgcccggccgtcttcctttccgtctttccaaatgtaaaaatcccgatacggactgtcaggtgacgagaccgcttctttgaaccacctgtgctcgacggatgtatggtttacaacaagatccatgacgaccttgatccctcttttgtgcgcttcattgagaagacgttcaaaatcctccattgttccgtattcttcataaatggtgcagtaatcacgaatgtcatagccattgtcattctgcggtgaatcgtaaatcggcgtaagccaaatgacatcaatcaaaagcttctgtaaataatcaagcttctcgataatgccgttaagatcgccgatcccgtttcccgtcgtatcattaaagctcttcggataaatttgatacaccgctgcctttttccaccatggtgtgctgtctgttttcatttttcttcaccgcctgtattcgtttgatttgaaaagggaaagggacagcctgaatgaaggcgtcccgcaggttatctattttttccgcttcagccgcgcatacccgtatgttcccgcaaacgggagaatcagcacgatcagcattccgagcgcaaacggcccccagtaccggctcatgatggagaaaatccccggcacgccgccgactccgactgagcttgccaaaacgcctttaacggagatgtacatccctgcgattcccgaactgatcatggcgatcacaaacggaaatttgtaacgcagatttacgccgaaaatcgccggctcggtaatgcccaaatatgcggaaatgccggccgtcagtgaaagcccccgctgttttttatcttttgtaatcagcatcatggccaaagccgccgatccttgagcaatatttgacaaagcgagcatcggccatagaaatgtgccgccgagctttgagccgattaattgaagatcgaccgccagaaacgtatgatgcatccccgtaatcacaagcgccgaatacagccctccgtacagcaggccgccaatggcggagaattggccgaaaatagcgatcaatcccgctgtcagcgcgtttccgatcgcaaaagtgatcggtccgatgatgacaaacgacagaaaaccgatgaccagcagcgtcacaggtgcgacgactaacagctgaatgccttccggcgtccgtttggttaaaaagagctcaagcctggcaagtaaataagacgccagcagaatcggaagcacctgaccttgatacccgactttctgcacctcaaggccgaagaggttccacaccggaatatcgccgctctgctcggcagccccgtagccccatgcattcaacagatcaggatgcacaagcatcagcccgagcacgatgcccaaaagcgggcttcccccgaaccgcttcactgctgaccagccgattaaagccggcagaaaagcgaaggccgtccccgcaatcagattaatcatattggcgagatccgcccattgcggatacacttggacaatcgattttgtgctgaagaaaatgccttccgccgttaagatgttgttcagacccattaaaagcccggctgtgacgatcgccggaaggatcggaataaagatgtccgcaagcgttttcacagcgcgctgcaacggattcattttttgcgctgccgccttctttacgtcatcctttgacgcttcgcctatccctgtttccttcactaactccgcatatactttgttgaccgtcccctgcccgatcacgacttgaaattgtccgtttaccgcaaaagaacctttgacaatgtctattgcatcaagcattttctgattcactttggtttcatctattaacgcaaaccgcaaacgcgtaacacaatgagtcgccgcctcaatattttcgattccgccgacagcttcagcgatctgccgcgcagcccggttaaactcacccatgccaacccctccgtaaccgttttcattttgtcttgtaaacttgtatatacatgtttatgactctattgtaatgatgtatatacatgtcgtcaatctatttttatagcgctttcatcacaaatatactgcgaaagacccttacacaaaaaaatccccgccgggacggggtcttgattacttgtttttcccggagcatgtccaggcggaatcacaacaggagcagcaaaagcatacagtactgtacaactaagttaaagaggtgtgaagagatgccatccactgttatcaacctgtactatttgaagattaacagtatttctggcaacggatctattacgattggggaagcggcatacaacagtcccaccacaaataacaaatcacaaggactgaactcttcattcggcgatacgtcacctatagaatcgatgatggagaacttgttaaatgatcctgatgtaaacgaccagacagccatcggaaccgcagataccgcaaatattacgccggtgccgcccattatagattaaaggggtttttatgaatgccttaccaaattaacgtcgtcaatataaaagtaaacggagcaacgcaaaacggaaacgtcgatatcggtcagaccgtacaaaacagccacaccgccaacagtaaacttgtcggcgcgaacttttctttaggagacttttcgccggccgccggatgtttgaattcgggccatcttgaccctgacgtgagcgatcaggatcagatcgccaacccgtcaatgccgatcgcaaatcaaatataggggagctatgctgaagtggatatcgaaaaaatgagaaagtggcttgagattacgaatgagcacaagcccagcgacttttggaccaatgtcctgaaacggaaatctcccgaagagtttttctccttacaaaaaaacaccctgatttatgatatctatcaggatgaacagtacacatttgtcattgtggaattgcccggtgtttacgaagaagaattaacattgaggctgctgtcaagaacacggctgcatataaaaggaaacatcacgcccctttttcccaaggacatgggaatctgccaaaaccggtattacggggaaattgatgagacgattgatcttcctgaaccggctgagccccatcttttacaggcgcagtgcgtcaacggcctgcttcacatttcctatccgcgtctgatggaacacattccttttcagaaaaaaatataaggagccggcttacgggcggttcagccatctgtacactttctccttataatgagaagatgcgggttttgagaacatggctttctcctccgtcagcttgtcgagcctgacttgtttttccgtccgtttgttccgcaggtgatccagctccgtttcattgcggcacttggcgatcaagtaatcgagtgtcatcagctctttcttcagcgcgccctcatcctcggcgatcccggcatttttcaagattcggtagcccattctgagcgactccggaagatgtgcagcatcgtctttcggcaggggctttcccattcctttgatgccggcgaattctccatccttaatggcgcgcttgattttatcttcagccacgatatgggcaatatccatcatttgtcacctctttttttcgattgaaccgggtcatatcacacggaaatgatggtcccagtttatcccatctttatttttaaagctgtcattcaacagataaactgcctttgcgacagcgtttttcgccctttttccgatgagccttttccaccttttctatttgctggtttcatggtatattgattacgttcgttttttctatcgttccgtgtaaaccgtgatcggaaaaaaggagtgtaacaatgaaaacatttataaaagaaagaggacttgccttcttcttgatagcggtcgtgttattgtgggtgaaaacatatgctgcttatattttaaactttaacctcggcatagacaacacgatccagaaaatattgctttttgtgaatccgctgagctccagcttgttctttcttggatttggacttcttttcaagaaaaaattacagcagacagccattattgtgattcattttttattgtcttttttgctttatgcaaacatcgtctattatagattctttaatgatttcattaccatcccggtcatgatgcaggcaaaaacaaacggcggccagctcggagacagcgcgttttcattaatgagatggacagacgccttctacttcctggataccgtcattttgattattttggcccttaagatgaaaaaaccggctgaaaaaccggcgaagaaatcattcagaatcgttttggcttccgccgtgcttgtattcctgatcaacctggccgtcgcggaatccgaccgacctgagcttttgacacgctcatttgaccgaaactatctggtgaaatatttgggcacgtacaacttcacgatttacgatgccgtgcagaatgtgaagtcaaacagccagcgcgcgcttgccgattcaagcgatgtaacggatgtggaaaactacatgaaggccaactatgacgtgccgaacaacgtctatttcggaaaagccgaagggaaaaacgtcatctacgtctcattagagtctctgcagtcctttatcattgattacaaaattaacggcaaggaagtgacgccgttcttaaacaaactggcgcatgacaatcaaacattctactttgataactttttccaccaaacgggacaaggtaaaacatcagatgcggaatttatgatggaaaactctctgtacccgctgtcgcaaggttcggttttcgtcaataaagcgcaaaacacgcttcagtccgttcctgcgatcttaaaaggcaaaaactatacgtctgccgctttccacggtaatacgcagactttctggaaccgtaacgaaatgtacaaagcggaaggcatcgataagttcttcgattccgcttattatgacatgagcgaagagaatacgaaaaactacggcatgaaagacaaaccgtatttcaaagaatccatgccgctcttaaagagcctgccgcagccgttctatacgaagttcattacgctgtccaaccacttcccgttcggaatggataaagaggacacagacttcccggcaggagactttggcgattcagtcgtcaataactacttccagtccgcgaactatctggatgaatcaattgaacagttctttaatgatctgaaaaaagacggtctgtacgataagtcgattatcgtgatgtacggagaccactacggcatctctgaaaaccataataaagcgatggcgaaagtgctcggcaaagatgagatcactgattacgacaatgctcagcttcagcgggttccgctctttatccacgctccaggcgtgaaaggcggccgtaatcataaatttgccggcgatgtcgatgtcgcgccgaccgttcttcatctgctcggcgtcgatacgaaagattatctcatgtcaggttctgatatcttatcgaaagagcacagagaagtgattccgttccgtaacggcgacttcatctcaccgaactatacgaaagtcgccggcaagtattacgatacgaaaaccggaagacttttagatgattcagaagtcgataaaaaagaagactctctcgtcaaaaccgagcttgaaatgtctgataagatcatcaacggcgatctgcttcgtttctatcagccgaaaggcttcaagaaagtggacccgtcacaattcgattatacgaagcgtgaagattcttcatcagatgatcaaaaagaataaacaaaagccagatcatattatgatctggcttttttatgttcaacttccggctgcggccattgagcgcttttgcaggctgtcggaaagaaccgaataagcgacgactttctttttctgctgtttgacgacatctacatgatcttcgtagctgtatacaaacaccgtcacatctttttttccttttctcgtcttaatgacaagcggatcggctccgttttgcggatgaagataacgctcttcatcacccgggtatatataatgccgttctataaacacagcttcgttaaagtcatcaatcacccggcgtttgtcttcgccttccagacgttttccgccgagggatacggcagcggactcgtcactgagctttgaatgggtttcaaatttgcggagaatccattccaccgctccggtaggaaggcatgtcagtacaatcttaatcaggcttatgacaacaattgaaacaactgcaatccacgtcaccttacatcatctccatacttgttctacatgaatcttaacacaggaggaaacgttgttttttgtacattatgtgaaacttgatagatatgcaaaaaatccggatcgcatatatgatccggatttttcaagtctacttctgatcgtcacggcggacggcctctctcagctcctccgcgacaaattcgacgttcgggccgataatgacctgcgccgttttattccccgttttgataaccccttttgctcccgcttttttaagtgccgcctcattaatgagagacgtatcatgtacggtcagtctgaggcgggtcgcacagtggtcaatcgtttcgaggttttgtctgccgccgagccccttgagcatggcatgttcttcaacggaaccggccgtatcttcactaagcacttcctcttcctcatcatcttcccgtcccggcgttttcaagtttaacgttttgatcagtacgtagaagacgacaaaatagagcaccgcataacaaatcccgacaacgagcagcaaaagcggtttttcggcaatgccgtagctgaggagataatctatcgcccccgctgagaacgaaaaacctgacctgattccgagaatattgacgataaataaagagaatccggttaataaagcatggaccccgtacagaagcggtgataaaaacataaatgcaaattcaatcggctctgtaattccggtaataaatgccgtcagcgcgagtccgatcatcatcccggccgtcgctttgcgcttacttggcttagccgcagcaatcattgccagacatgcggccggaagcccgaacatcataatcgggaagaatcccgtcatataagtcccggccgtcggatcttttgcaaagaagcgggccagatctcccgtttttccgtgaaattcaccaaactggaaccaaaaaatattattcagcacatgatgcagaccgaacggaatcaaaagacggttaaaaatcccgtaaatcccggcgccgataccgccaagcccgatcatccattctccgaatgatgtaatcactgactgaatcggcggccacacaaagccgaaaatcccggccaaaataatggtgatcagcgccgttacaatcggcacaagcctgcgtccgctgaaaaatccgagatattccggcagcttcgtatccttaaagcggttatacgtgtaacccgcaattaaccccgcgataatccccccgaaaacggccatattatttgtcgaattgattgattttacagccgcctcaagcattatataggaaattgctcccgacagagcggcggccccgttgctgtctttcgaaatcccgatcgcgatcccgatcgcgaaaatcagcggcagatgatcaaataccgctgtccccgccgcgtaaatgaacggaatatttaataagtcctccctgccgatggccaaaataatacccacggcgggcagaacggcaatcggaagcataaaagattttccgagtttttgcaaaaattgaagcattttacccatcccccttcttttttcttaaatataacacataagttatctagtgatctataccaattttccttcatttattcagacacggcttgttggttttctatttataaaccagttgtggtaagcttgaataagatgaataaaaatagaaagcgggaatgacaatgattgtaacaaacgatcaagaattagaaggcctaaaaaaaatcggcagaattgtcgcgctggcacgggaagaaatgaagaaaaaagccgagcccggcatgagcacgaaagatcttgacctgatcggaaaggcggtgcttgacgaatacggagccgcttccgctccggagaaggaatatgatttcccgggcgtgacgtgcatcagcgtaaatgacgaagtcgctcacggcattccgagcgcctctaaaatcctaaaagcgggggatcttgtaaatatcgatatttcggcggagttcggcggtttttactctgatacgggtatttcatttgtgcttggcgaaggtgacgaactcctgcaaaagctctgtaattgcgcagcttctgcatttgaaaaagggcttgaacaggcgaaagccggcaagcgccagaaccagatcggcagagccgtctaccatgaagcccgctctaacggctttaccgtcattaaaacgctgacgggccacggaatcggcagaaacctccacgaagcgccgaaccacatcatgaattactacgatccgtttgataacgcgctttttaaaaacggaaccgtgatcgcgcttgagccgtttatttccacgaaggccgaaacgattgttgaagcgggagacggctggacgtttaaaacgccggataaaagccttgtcgcccaagtggagcataccatcgtcatcacaaaagacaaaccgattattttaacggcattgtaatgtttcatttccctcccaaacaggtatacaacaactaacccgaaggagggagacgcatgaaaaaagataaagaacaaatcaaaatcgaaaacgaaatacacgccatgcacggcgtaacgaagcagcagattttagaggatttcgaggaatttaaggcgtaccttcaccagaaaatttccgccggaaaaaaactaggcctggatgacagcaaaatcatcaaaagcgccgccatcctcggggactatctcgccaagcacgaggagccccgcaatgcggaagaaaaactcttacaagagctgtgggacattgcggatgacaatgaaaaacagcatttggcccagctgcttgtcaaacttgccggacactgatacagtgcccggctttttatgttccgttataagagatgtgctacactggagatatgtctgtgaaaggagccatttttcaacatgtggtttattatcttcgggtttattttctttattgaaagcatcattctcaccgtttacggggtgaagaaaaagaaggggctgctgatttatttcggcgtcgtattcggaatcatgacgctcggcacggtgctgttaaaattgaccggccattaagcatgaaaagaccgccctttacatatatatgtaagaaagctttacatctctgaatcgaaaggctcagtttttgcttacccccttttcagcgtctttttatagatgttacaatgccaaaagtttggcaaaaactgaagaaactctcctaagcgggagaacggagaaaggagttttctgacatgcattatggcagtaaaggctggtatgtagaagagttaaagaaaaaaggaattacccactatgaaggaagaaagcttcaaagcttcaaaaagtatttccttgccaatctgctcgaaacaaagaaacaagcataacgtaaatcagccgtgctgtcagtcagcacggctttttttctatacattcatcagtctgtctctttttttaaggaaggagtccctccagctttctgacagcgcttcttcccgcagtacttcttcgatcgccgccagattgccggaatcgcggtatttcacttcattcgcataccagacggaaatgctttctttgcctctcgacagacgcttgaggaccggacgcggatcgacatatccctcttcaagcaccctgaaataaaagccggtaaagccggtctgctgtacacggagcaccatatccttgatgtcatatttgagcgcgagtttgacgcagggctggcgcggctggctcacttggacgacggcttcccccagctgaaacacgtctccgatccacacgtcttgctcggccagccctttgaccgttacattttctccgaacgcggcggcgggaagttttctctcaagcgttgtttcccaatatgaataatgctcggcgggatacacgcacaccgctttatccgggccgccgtgatgcttcagatcagcttgtccgtcccctgcaaaatgggttttatacagcatgacgggggaatccgcgggccgctttacgatgccggaattgatttgtctgccggcaaattcatgaatggcgggctttccgagattgatagataagacagaatagtcttgcgtcacctcgttcacatcctttgcgaaatatcatatttatcctttatcatagtaagaaaaaggtggtttttccatgcttcaatatcgtatggttgcagacggccgggttcagggcgtcggttttcgctacttcgttcagatggaagcagacagacataagatcgccggatgggtaaaaaaccgtgatgacggccgggttgaaattcttgccgaaggccctgaagagtcgctgaaaaaatttgccgaagcggtcagaaaagggagccccttctcaaatgtcacaggcgtaaccgtcgaagaatcacgccatctgaaagggtaccgcaccttttccatcagttactgataaggcttgtcctggtaaaaataattcggcttcacaatcgtattgtcatatgatttatggaaaatgtgggtggaagcaggcgagatcggcgggatcagccaggtccagtctcccgtcagctttctgcccgcgtcttgttcctgctcttcaaagcgcttaaattggttcgccgccgtatggtgatccacgatactgacgccgtgttttttatatgaatagagcactgccttattcagttccacaagcacctgatctttccacagatcggtattcaggctggcggaaatccccatgaccgacgcgatttttctgagcaagtcataccgtttttcatcagcaaggttccttgcgccgatttccgttcccatataccatccgttaaaaggcgccgcgttgtacgacagtccgccgatttcaagcttcatatcggcgataatcggaaccccgtaccatttgagattcatatcggcaaactctttgatatccggatgggagatcggcacttctttcacgagcgtctgaggcaggtcataccagaccggctgctcgtcccctttcattcggaaaagcagcggcaaaatatcaaaatcggtccgctttccgcgccagccgagtttttcacagacagccgtcagctcatatgatgccggatcgccgattcttccttgttctgtctcataccccgcatagcggatgagctggtgattccagatttccacttgtttctccccattcttctcagggggaaaaatcgtaatcgtcggtttaatttttccgccgttcgtcgcgatttcgatatgttcaaataatgcgtcgcgcacctcttctttcgtgctcacgccgcgccggtcaatgacgttcagcgattgccaaaagagacgtccgatacagcggttgctgttgcgccacgccattttcgccccgtgttcaagctcttccgccgtatggacgtaacttcccgtccgatctatctcatcttttatcgcgtgaagacgcgcattggtttccgattccattccgagttcctgatagcagacatcaataaaagctttcgcctcatcccagagtaattccgtatgtttcaaaaaactctctccttcaatttacatctgcttcccattgtatcgtttttagaagtgaacacaatggtttttttgtatcatactggaaagtacaaagaaaaaacacctgtgattttcgcaggtgttttacaaaacggaatgcagtttttcagccaatgtaagcaaatcctcacggtagtttttgcccgtcatcggaattccgtgacccgtcaaaagcgcttccggctccagttcggccagtttccggacggatgctgccgcagtctgcgtatccgctgtgaaatacgccggcgggccgtgaagctcttgcttttgaatgacaacgtccgcaagcgattcctgttcaacagtgatgacggcatcaccggcaagcagaacgcggtctttttgccggaaaaaagaaatatggccgggcgtatggccgggcgtatgcacccatttccattcttcaagaaacggaacggtgccgtctgaaggcagggtctgaacggacggaatgcggatcgcatggcgcggaaacagcggcgacagctttgcgacaagcccttttttcgcatcgggcctggcaggcggataatccgcttttcccgtcacgtacggaagctcctgttcatgaatataaaccggcacatcccacatttcaagcagctcttcaatcgctccgacatggtcaaaatggccgtgcgtcagcatgaccgccttcagctgatacccatctccgaaccggcgtttcatttcttctgtaatcatctccgctgattgcggcattcccgcgtcaaccagaatgatttcccccggagctgagggattttcgataaagtaaacattcgcaatctggacggtcagcccgtaaacaccgtccgccgctttaaaaccgacaccgcttttcaatgaaaagagcggcataaacggatcactcatcatggcacctcctctgatgcctttagtgtgcgacgaagcggatgttttatgttaaaaaatcgtgatcgcgccgatgatgagcgcaaaggccgtcatgacgataacggcaagaaccgcccatttcatcgcaaatttctggtgttcatcaatggttaccccggcaagcccgactaataaatgcgtcgacggcacgagcgggcttaacatatgaatcggctggccgataatcgaagcacgtgcgatttccaccttatccacgccgtatgccacggcagtttcagacaaaatgggcagcacgccgtaaaaataggcgtcgttgggcatcagaaacgtaaagataccgctcgttaaggcaacaatcgccggaataaatccccccatctgctccggaataagcgatacgagggaaatggccatttcatcgaccatcttcgtccccgttaaaattccggtaaacacgcctgctgcaaatatcatcgaaccgatcgcaagcacattgctcgaatgggctgaaattcgctccctttgatcgttaagcctcggataattgacaatcagcgcgatacaaaacgcaatgatgaacagcacggttaaattcacttttcccgatactaaaaaccccactaaagaaagtgttaacagcaaattgaaccaccacagtttcggccgcttccattcatcttccactgccgcagcagtttcatttgtatgggacggctgctttaattcgatcaccccgagccgtttccgttctattcttccgagcacataagcggacaccatcatacataccatgccgctggcaatgacaggaagcatcggacccgtcagctctgccgggtccacaccgagcgcgcttgccgcacgcggcgtcgcgccgccccatggaatcgtgttcatgatccccatgccgacaccggcaattcccgctaaaataatcggacggattccgagcataatatacaaaggcagcatcgcgcttgtcgtaatcatatacgtcgtcgagccgtcaccgtccagcgcgacgagcatggtcagcgctgctgttccgacaacaattttgagcggatcgcctttgaccagctttaaaatacgcgcaaccatcggatcaaataaaccggtatcaatcataatgccgaaatatagaatcgcaaacataatcatgactgcaatcggcgccacctgttcaataccggagatcatcatctcgccgacccggttaaaagaaaagccggcaatcagcgcgaacacgatcggcgtcaacacgagcgccgttaacaccgaaagccgttttgtcatgatcagcaccataaaaacaaacatcataagaaagcctaagattgctaacacagtatgtcccccttatcatgaatacgcttacattttaaaggcccgattcccctttatctgcctttttgctatcttatgagaattgcataatgaagtaaatattttggattttaaagatttttaattttttataacctttttgatcattttgttcatttataaataaaaaagcattccgcaagtctgcggaatccttatttttcgctgctcatcatctctttataaaactcagtctgctcttctaaaaagcgttttgcgccgctgctgtttttataaaagctctcccaatcccgttttttcatcatttgcttccactccgcggatgaggtaatctgtttcaaagcctgatcccaataagcgatctcgccttcggtcatgtctttcggccccatgatgcccctccagtgcgcaaagacaaacggcaccccttgctctttccaggtcgggacatcgctaaagccggagagccttttgtcagaagtaacggccgctaatgtgatttttcccttctgataggcggctctcgcttctgaaatggtcattgaggcggcatctatatcgtgactgataagcgcttcaataacctcattgctgctcccgtattgaaaaaagcggatatcaaacggagaaattccggccatttccgcggctctcgcaaaggagagctggtcatcatttccaagacctggcgcaaatccgatttttatgccgcccggatgtgttttaatagcaccgagcagctgcttcccactttttatctttgaatttttcggaagagcgacagtctgccactcttttgcgataatggccaagggcgtaaaatcagctgccttcagccggctttggcccaagatttcattgcttaacagcaggcttgaattcatactgatgacatccgtttttcgttcattcacgtatttccacccgctgtctccgcctccgccgggcttatagacgatctttacaggccgtcccaaaatatgtttccgctctattactgattgcaaagcctttgccgttacatcccagcccccttgaggcgctgcgggtacgacaatttcaatcggtcccccggctgagcggatgcccgccatctgccgtccgtccaaagaaaccagcgccgcaagcataataagaagcactccaaaccgcttcatttctcccatcccttattcatgtgctaaataatattttcgttccggcctgccgataatgccgtattctaattcagcgagcgcttcttcccgagaaacgagaaactcggcgtagcgccgcgccgttgttctggaggcgcccattttttcgcccagctcttcagccgtcatccctttttgggcagtccggagcgcgtttttgattttttgaagggtaatagagttaatgcctgtcggcagatcactgagctgtttttgttctttctgactgcttccgaaaaacatgtcgattacggattggctcagctccggctgtgagtgcagccattctcttttttcacggtactgcaaaagcacatctgtaaatttacgtgccgaaaccggttttatgacatagtgggaaacgcctgatctgagcgcttcctgcagcagccttgtttcagcagaagccgtaataataatgatatcaacggaaggaaaacggcggcggatgagcgggagcagatctgttcccagctcatccggcatataaatatccaatagcagcagatcaggctgctgtttctcaagcagagataaggtgtctttggcgttgattgctttgccgatgacattgaacccatccagatgttcgataaatttttcatggatttgcgctattcgaaagtcgtcctctgcaatcgcgatgttaatcacacggattccccctttggcctttctttcggtataaacaccgtaaatacggcaccgccgctcttttgctgtgaaatctctatccatccctgcaattcactgacggcttccttcagattggctaagccgtatcctctccttgtcccctttgaagagtatcccttttcaaatatcgttcctgttttttcctgaggcacgccgtcccctgagtccgccacttctatgacgatatccctgccgatatcggtcataaaaaaggcaacctcttttttctctttttcggcgacggcgtcaaaagcgttatcaataagatttccgatgatcgtaatgagctgggatgaacccacatgctccggcagcgactctaaaaagctgttttcatctatcgagagcttcacttttttctcagaggcttttcccatttttcctaatagtatggcctgaacacgctgggaatgaatgttttgaaataggatttcatgctgttcattttggatggcatactcttctttaatcagttcaatggcttcctcgtattctcccagctctaacagaccgagtatcgcgtaaagcttattcgagaattcatgcgtttgcgcccgcagatcctccgagtattttttcatttcggtcagcttgttaatcagctttttgagctccgttttttcgcggaagcttatgaccgctccgtatacttgcccggcctgcctcatttctttcacgtttaagatgaatactttatctccggcacgcacctcaacattcggcggcacttctccccctgacaaaaccggcatgagctttgcgccgggcatgatttcttttatatgccttccgatcatcggctccggaagatgcagcatatcagccgcggataaattcatcatcgttatcgcgccctctttgtttacggcgataattccttctttaatcgcaaggagcatcgcattgcgctcccgatacagcgctgcaatttcatgcggttcaaggccgagtgtatctttacggatgctttttgcgagtgccgccgctcccccgataccgataagaaataccaaacatgcaaaatagcccaaatgccgcagatgcgctttcatatctttttctatctcatcttgtaaaaactcgactgtcaccgttccgacgacttcgttatgatttttttcatccagaataaccggcgcgcttccccggacggctttcattccatcggaaaccggagatccgccgaacataacggttttattttgcagattttgattttcttttgggatgctgctgcgggccgaatgaaatgcaacatgccctttttgatcagtaatgtagacggcgtgcgcacctgcctgttctttcatttgttcaatgacgtctaactttgtaaaagcaccttcgtccgcaagccggaatgcctcttttacaggcggcatgtaagaaatggtttttgctgtttgcaccgccagctgttcagcctgcttctgcccttcatttaattgctgaaaagcaaatataacggtgagcgttccgatgacaagtattaataaagccgtgattaatccggctattttcatttgcagagagacataaaaccgcttctcttccaacacagcaccagccgtcctttcctcctaaaatgataccacttttcaaatctttatttctcatttttatgaattttcgtgatctttttctcttgtaattcctgtaaaaaagtgcgataggtatcattttcctcaagagagataagcaggacgacctttttataaccgctgtgcaaaaaagagactgacagaagccagtctcgggaagtttaattactgacgtatatccagttgacagaatgattctctaagatggctgagatacatttgaatgaccggcaatatcaatcaactttcctttgacggccagacgtccttcggtatttaccgctttgtcacatgtgattaaagtaatctctttttcttttgtctcctgaattatgtttgcttctatttctgaaatcgtgctttttgatgttacagaataaatatagtcttttctaaaatcggtaattacgatttgcgcgcctttttttatgtgtaaaagagggccgaacaataggttctcctgcctcagatggtgaccagccaacgggtagtttccctctcccattttctgatccggccgcatagttgccgcgccgatcagcaggttttcattggttgtgccttttaaaatcgggagctccaaattgacgctgctgatggtgatccgtccgattatcggtttcggtttgcggttaaaactcgactgaacggtttccctaaaaccgggaggatgaattgaatcaaatgcataatccgcttttttcatgttgtttttccgcgcctgttctgcggtcaattcagcttcactatggcttttactgaggtaagcgataaggcaccctttcatgagaggagaggtgacaagaagcagcccggatagaatcagaacagcaatgatcgtttttttaaacatgaagaaaattcctttcttgtacataatacgggatgggtacttgttgtgaaatgactttcgttttaaaaaagcacctgatcgattcttacatgatcaggtgcggtaacgtctatctatttcttgccttcttctttcttgatacaagagccgcggctccgccggctaagagcagcagaataccggccgtcacctgcatcataccgtccgtatcaccggttttcggcaggcttttgcctgtatccggatgattggcattaccattggtatcagggtgatgcccgccttgcttcgtttgatgattcggtgtgtctttcccaagtgcgggattttttaatttcttattcgaaacgacaacttcaacagcttttgactgtcctttttcaattgtgaattcaattggtttttcgttcagctgatagccgtcaggcgcttttgtttcgataaatcggtactgtcccggggctaaacctttcaccgtaaactgtccctttttatccgttttccataacgccggccgtttttcgctggttccgccggtgtttaccggatgtccgccggaatctgttatcttgaattcagcaccctctaacaccttatttttatcgtcatgatccacttttgtcagtgttacatcgccaggtgttaatttgttcttcgcactgatttcgattggttttatgtcggtatttgtaaccttgaatgatattggcgtttgatccaaactgtaaagttcaggcgcttttgtttcgataaattgatattcgcccgctttcagtccccgcacaataatccgcccgtgctgatctgtagtcagaccctctgtcagcactttgccgtttgcatctgtcagtttgaactctgcatctttcaggactttccgtttgtcgtcttgatcgaattttgtgagaacaacactgttcttgatgttaactgcagtcaggacagcctgatccggttttccgctgttctcagccttaatcgtaaacggcacaggtgttgttgacagcagataaccatccggtgcttgtttttcaacaaattgatagcttcccggtgccaaaccgtcggcgtcaatcttgccgccttcttttgtcatcagatcgtctcttacagtttttccatcactgtcagtgattttgaatactgcaccgtctaaaacatttccgtcttgatccttcttgaccagctggacagagcctttgtagttgacggccgttcctgcgtcagacggcttcggctttccttccgccgattctgagatcgtaaactccactttctccgtatttaacacataaccggctggcgcttttgtttcgataaaagcgtagtgccccggtgcaagtccggatgtttctacttttccgtcctgatctgaaaccagatctttttgaactgtttttccatcctgatcgataatctggaagactgcaccttcaagtttccggccttccgcatcttccttcgtcagctgaacagagcctttatagttgacggccgttcctgcgtcagacggcttcggctttccttctgctgattctgagatcgtaaactccactttctccgtatttaacacataaccggctggcgcttttgtttcgatgaaggcgtaacgccccggtgcaagtccggatgtttctacttttccgtcctgatctgaaaccagatctttttgaactgtttttccatcctgatcgataatctggaagactgcaccttcaagtttccggccttccgcatcttccttcgtcagctgaacagagcctttatagttgacggccgttcctgcgtcagacggcttcggctttccttctgccgattctgagatggtaaattcttttttctccgtgtttaacacataaccggctggcgcttttgtttcaatgaaggcgtaatgtccgggtgcaagtccggaagtctctactttgccgtcctgatctgaaaccagatctttctgaaccgtttttccttccttgtcgatgattttgaagactgcaccttcaagcttccggccttccgcatcttccttcgttaaagcggcttttccttgataattaaccattgatcccaattcaacatcaggcacttgattcttttcgttctttgcgactgagaagtgaatcgcttttgtgttcacgataaaccctgaaggagctttcgtctccatcagtcggtagtaccccgctggcaaaccgtttatttcaaccttcccgtttttatcgctttcaatattacttcttattaatgtataggtaccgtcgcttgattttttctccagcttaaatacggcaccagccaaaggattgttgttttcgtcttttttgataagcgtcaccttatttttttgatttatgactttgtagggagcacccgccccggaggatttactgtcgaccgttacaaggaccccgtttacataggcgtcgctgatggtgtagccgtccggcgcttttatttctttcagtacgtaggttccgtaacggatattcccaaacgtaagtttaccggcttcatctgttgtgcctgaacgcagcagctgcttgccgtctttagaccataattgaaaatctgctcccggaagagatgcaccgtctgatcctgttttggatatcgtcatgcttcccttctctcctgatcctgaaccgccgccgcttgaaatggcgacaagcactgagctgttattctcctgggtctgctccttaacatttgtccctgatattgatactttgttgttgacctgaccgctgctgccggaaatattaatgagagaacgatattgtatgacatacgcacggtctatttgtttatagctgcctgtaaaggtgaggacaaatgattgttcaccggtggcattgtcggttttaacatctaatttatagtccttatctttctcaagctgcacatcacccgcagcaaggtttccactgctgtctttcataacgccgttctcatcatattttgcttgatatactttaaaagaatcttcatctattatttggttctcatctggggtgtctttgacttttacgtcatccagtgtcgattggctggcattgacattgatgttccaatcgatatagttcccgctctgtttaccgcctttagaaaccaggtttccgccgtttgcgattgatactgaacccgtcaacgttcggtctgcatggtcatcattatagtactctgctttgtttgtgtattgattctgtttaatgacctgacctttcagtgacgttttgaattcaatcagatatggtacagagtcctctgttttaagatgtacggttaatgtatttttgttgccgtctgacggttcttccacttcgtatttcgaaggatccagcgcctctccttcagtgatggaaccgtttttactgatggtgtactttttgacggcaaccgacccgtgcaaaaattgctgaccatctgttagcgtatcttttatataaggattctttgaaggttcgccattgtaattgatgccgactttccatgtgatttcttttgaaacggcgttgtatgagccgtttttgaatccgttatgggaagtctgattgttcggtgtgaagccgctcgattccttatttgtgcgtttgccgccattttgatcggtccatgtcgactccgccgtattcttgatgttttcattagaaaagtcagtgttgaattttgtcgtatacgtgatcttaaactgactgtttgtttctgcgtaatccccgatcaatgctattgtaaagccttgatttccgggtttttttgttattgtataatctgttccttctttcagcgttttgttctcagtcgtatcttgcatgtgaaatgaatcatcaatgagcgccagacctccgctggtgaattgatcatccagagtccagtctttcattgtgtaacggtttttattgattgtgattgtccaatcaaccgtcttcttctcatagtctgcgtttgaataatttttgatcagattctgctgaatggctgtccccggagtttcctttgattcccccgtatctgtaactgctgtgttggtgtatttgacaggactgtcaataatgaccccatcgttgacttgagattgataaatgatcttatatgctcctgtgacagtttgcttgaatttgatctcaaagccgttcccgttatcagtcagcgtataatccccgccttcttttaatggggcgccttcttgttcgctgccgttttggctgaatgtaatcggaaggactttcaaagatccgggaacaaggtgcagatcgtctgatccgaacgtatccttgatgccggctttggattgatcaatctttttctcaccgtaattgtacataacagcccagctgaacgtttgggtttcccctttataaccggtcgaagatttttcaatcatttttccgtagcccgccgttacggaggcttccgcagaaatcggctccgcattatccccgctgaatgccgccttgtttgtcagcgtgatatttccgcctttagcaggctttgcatcgtcatcaataactgtgtcatagatgagccgataggctgaatcaatcgtcccggcgaatgtgacatttcctttgtcgtcgacggtatagcctgacgttatctcacttccttgactcaccgagccgtcaatattcacatcgagttcatacactttcacagagcggaaggtcaaaccgtccggaagactttccgtcaatttcgcatttttgacttcttcttcctttttattaagatcaaccgtccacgttacctttccggggttaatgcctttatccaatgaccctgatttatcaatggttttagtgacattcggtttaaaataaaccgttacttccggggtatcagagttaaccggaaacttaatcttttgtgtggttgacccttttatttctttctgattgaattgggtgtttacatacaatgaccctttgacattaaaatcttcttttacctcgccgttaaacgtcatgatgacatggccgctcgtattaatggaaaaagttccgtacgtcatgtcgccgttggtcaatggctggttcgtaatgtcattgtgcatgataaattctttaggcaggtcaaattcatatcgatcaccgtcgtttattgttttccccagctcattcgggatcgcccattgaatggtgatatttgccggagaattcgtattcgcacggttgtttttgtcaaatggttttcctttttcatccgtcaatttcacatcagttaaaatattttgcgtaatctggcttccgcctgattgaagacttttaacagcagatttgcttgaaatcaccatttttgattgattgcgttcagcagaagggcttgatttcgttgtctgttctttcttatccctgctgtctgcagatgttgactttttctctgcttcttcctgaggttcagcaggttttgaagaggtgtttttttctgtttcggaattcgttgtctcatctttcttcacaggtatgatcacctgctgggtcttgccggcgtccagttgaaaaagagcttttgccgttttcgttttatctgttacgtcaggtgtaaacttcgccggcagtgtaatggagcctttgacatcatcggcctccgccttttccttgttcactttcacctcaagagtgctgctttttgcttcagctttatatataccgatcacccgatcagctgatttcagctcaccttcgatatcgttatctaatgtaaaactttcagggatctttaaggtgatatttcggtcacttgcatcttccttgtttttcagagaccattcgtatgtcagtgtcacttcatctttcggtgctaaagccggctcactgccttttgatccgtcaacggtctgatgtttgccgtctttgaccgtgactgaatcaaagaatccgctctcgcttagctgcgatccggaagcggctgcgatcggagtaaagctgacaacttggctgaagatgaaaaacagcgtgaagcatgtgatcaatgctgttctcagccttttgcttttttgcgggctgaacgaaaagttcctcactcccaatgtcttattcctccccttttatatagacttacgttcgaacaagcccgtaagcatgggattctccttatccgaaccaaactacattgtatgaaatcgacctatacaaattctgtacataggatcatttcagaaataacgcacaaaaaaagaccggcatcagccggtccagtccttcacttgtttatagcgttcatattcttttatcgcctcttctacttttcccaattgattaaataactgcagtttgtattgtataattttatcgtcacggggctctattttctcgacctgcaggcaaacgtccattgcttgatgctcgttcttttcttgaatgagaaaatcaatcagttcgtacgccttgctgagccacagatgcgccagacgtgttttttccggctccgcccacaggtagccattctccatcagataatggttctcatatgacatgacaatgtccatgtgccgggttaatgcggcttgactgagcgggggagcttcttttaatgtattttcccagtcaactgtatcaacctttacccctgaaagccgaagaatatatcctatatcggtattttctatggattggctgaagggaagctgactgattaatttccgtatctgatatattgtcgagtagagctgagtgctcgcttttgaaacttcataagcaggccaaaacatctcaatcagcatgtctttactgaccgtgcgcccttgattaagaagtaaaaatgcatacagttcacgcgctttggatgttctccacttgactgttatgtatgttttgacaccatttaacgattgataaaagtccaggtttccaaaacattgtataaaataatccgtcccggtgttttcgtctgccgtcctgagctttttattcattcggattcgctcaacggttgtcagcagcctggcattgtcaaccggttttaaaagataatcaacagcatttaactcaaacgcttttatagcgaattcattataagcggtgataaaaataatttgaatattttcattaattgcctgaattgattcagcaagctcaataccgtttatcccgggcatttcaatgtcaagaaacaccgcatcagctgctgaaagccccgaatactccagaacgtccgccggatcttgaaacattaaaatagattgaaaggcgtttgtccgctcaagcatatgattaaaatgaagcaatgccaattcctcgtcatccacaattatcgctttcaaaacgcatcccacccgtcaatatagatatctgaaaataatttcaattataccatgcccaacgccctatatagttggattctttttctttctcttgttgttttatgaagtttaggattacaatatttatacattgaataggataatagaatgaccctgaatgggataaaggagtaatgatgtgaaagaaaaattcatttctatttcgattatttgcggctacgctgccttctttatcatttttatagccatggatcatttctccggaacaactctccctaaagcagaacagggagtgatcaatctgaagaattgggattttcataaggacgggaatgtccagctgaatgggaagtggtttctgtatccaaatcaaatgctgtcaccgcgggatcttcattcagaaaaaggaaaaaaacctgtactcgttgatgtccctgtcaatgtgaagctgttcagaaaaacagccgatacggattacggaacgtacaaactgacaatccgctcaaataaagagaatcaggttttcggaatcagcacatcttttatctacagttcaaaccgcctttatcttaatggacaattgatcggacagagcggcagcccttcagagaaagctgattttgaggctcagaacaaaccgtatacttgctttttcatgcttcacaagggtgataatgaacttgtcctgcaattttcgaatttcggaaaagtgcctggctgggggatcgcaaaaccgataacgtttgggactcaagaacaaattatacgcgaaaatcaaatttcctttcttaatgattccattatgatcacggcttttttcattaccggtttatattttctcggtttttttctgcaaagaacaaaggctaaacatttattgttcttttctgtgatgtgtctgcttttttctgcgattattcttatgatcggaaaagaaagaatgatctttctcatctttccgtctatatcattttcattgctgaatttgttgcgcagcacctcttccgtgcttgtcagcattgcggtttttctctatctcttttatgcatacagagaaattgtgtcaaaaacgacaataaccattttaactgctttttcggggatcatcttggtcactgattttatgtctgtaagttttattgaccacctctcttacattttacattcggtccttgccgttacgactttgttttatattacatatatttttacgattgctgccatacggaagataaaaggaagcatgtaccttacgctggcatctgtttcaatgagcgcctttgtgattcttacgacaatttcagcttacagcggcagaacggctgtttcttttaattcgatttattcattgccgacagtcattgctttattggcactggttcttctgatggcgcagcaattcgccggggctttccgggacaatgaagtcctctcacgtaaattagtcaaaatgaaccagctgaaagatgaatttatcgccaaaacttcacacgaattcaaaacgccgctgaacagcattattaatatatgccagacgcttgtagccggcagaaaaaagaagacgatagaggaagagaaagaaaacatgcagctgatcatcaggatgggctacagactttccaatctcgtaaatgatattcttgatttggaaaaaatgaagcagggtctgctgcagattcgtcctgttcctgttgatgtgcatgccgcaatatgcagtgagatgaacttctaccggcttttgtccaagcataaaaatctcgacattcttaatcatgtaccggacgatctcccctttgtgcttgcagatgaaaaccgatttcggcaaatcttaacgaatcttgttgaaaatgcaatcaagtatacatccgaggggaaaattattctttctgccgaaagcctgaataacagcatgattcaaataaccgtggccgataccggcagcggcattcctgaagctgatcttgaaaccatttttgattcttttcagcaagcgggaggaaataacgaggatggaacgggtttaggtttaagtattgtgaaacagctcgtcaagctccaaaacggggacatctgggcagagtcggaagaggcgaaaggttcagcatttcattttacattacccgccgctcaaattgattctttaccggaagcaaagatcggacttcctaaatcgcagcccggacagaaaatgccggatatttctttgagaacgccttatcactcaaaaaaaatcgatgctccgacaattctgatagtcgacgataacatcgagagtttaaaaattttaactgatatgcttgaaggtgttccttataacgtaatcgcagtaaaaagcggaaaagaagcgcttcaagctgtctcttcctcgaagcttgatttggtgatattagacttgatgatgcccgacatgacgggatttgaagtctgcacaaatatccgcgaaagattcagtatggtcgagctgccggttcttatcgttacggcagccataatcagccatgacaaatacaaggcttttcatgtcggtgcaaatgatattttacagaagccttatcattactctgaattcaccgcgcgtattaaaaatttaattttgatgaagcatacggctcaccaagccacaaatttggaaatggcatttcttcagtcgcagatcaagcctcactttctttacaatgtattaaatacgattatcgcgcttagtcatttggatattgaaaaagcacgggaaaccactgctgcatttacaaactatttaagaatgagttttgattttcaaaatacttcggacatcagctcattcaaaaacgaactttctatcattacgtcgtatctggctatcgaaaaaacacgcttcggcaagcggctggaaatcctttttgacatcgatgaggacatggacttcagccttccgcctttaatgatacagccattggtggaaaacgccgttcatcacgggatcagcaagaaaagaggcggcggatgggtaaagctgacggcaaaaaaacaaagcgaaaacacatatttaattaaagtggaggataatggaaccggcatcatgccggatatacaaaaagatatattgtcttcccatgttgaccgcagtgtcggcctgaaaaatatcaatcggcggctgaagcatttttgcggaagtgaattgactattgagagcacaccggatgcaggcaccgcggtttcgatgatgattcacatcaccggcacaacggatgattcaaactcattaaaaacgtcttcatctgtttaagatactgattaacttcagaaggatgaaatacttctgccggctgtcgggaaattcccgtcagcctttatttactcagaaagacgaaaaaacaaaaaagcttgaagaaaaagtgataccttctccaagcttagatgattcacaccagtctggccgttttcacttaagaaatcgtaactcccgcgcttgcatatcccgccactgtattaataagagaaagacctgtcgcagtggcggagaataccattaacagccgggtttgaggagttaccgcaatgttcagccctgtagtgattccattgctgatgctgccgatggataatacgccggtaagggcaggagccaaggtgacagatgctccgggaatcggtgtgaacgtattgttcggcacagttgaactgtataattgtgcagttatcgtgacagtcgagccgacaagtgacaatgctgcggttgtactgaaataggcggcaattgatgtaatggttccgcttctcggagcagaaaaagcaaagttcagcagagtccctccggccccggtaagatcaattgcacctcctcctccgacattgacgcccgtcacagaactgccgaacccgacaaggctcaccgttccgattaatccgccggcaatggtggtcacggcagttggaaggcctgaagcataaggaatgatcgcgcctgctccggtggctccggtggctccagtggctccggtcgttccggttactccggttgcacccgttactcctgtggcgccagttacccctgttgatccagtggctccagtatctccggtcgaacccgttactcccgtggctccggtgattcccgtggctccggtgattcccgtggcgcctgttactcctgtgacgccggttacccctgttgctccggtggcgccggtgattcccgtggctccggttacccctgttgatccagtatctccggtcgagcccgttactcccgtggctccggttgctcccgttactcctgtgacgcccgttacccctgttgatccggtggcgccggtcgttccagtggcacccgttactcccgtggctccggtatctcctgttactcctgtgacgccggtgattccagtggctccggttacccctgttgatccagtatctccggtcgagcccgttactcccgtggctcccgttactcccgttactcctgtgacgccagttacccctgttgatccggttgcgccggtgattcccgtggctcctgttgcacccgttactccggtcgttccagtatctccggtcgagcccgttactcccgtggctccggttacccctgttgatccggttgcgccggtcgttccggttactccggttgctcctgtggcgccggtgattcctgttgttccggtatctcctgttactccggtggctccggtggctccggtggctcccgttaccccggtggctcctgttactcctgttgatccggtggctccggtgattcctgtggctccagtgggaccggtagcacccgggtctccagtcgctcccgttactcctgttgcacccgttactcctgtgacgcctgttgctcctgtgacgccggttaccccggtgattcccatggctcccgtcgcaccagttattcctgttgctccggtgactcctgttatccctgtggcacccgttactccagtcgttccggttactcctggatctcctgttggaccagttactcctgtggctccagtgggaccggtggcacccgggtctccagtcgctcccgttactccggtggctcctgttactccggtggctccagtcagccccgttgccccagtctctcctcttccatgataatgattcggatgacagcacggacaccatctttcatgacagcaagagttttcgcaacagcatccttcacagcaatgtgcccgattatgatagctgcgcctttgatttcttcttttatgttgagaatgacagcaacaatcattacaatgccggcagtcgcaatcccaagaatcacatctgctataccaagtatctccttttctcattacaccacctcttcttgcataatattttcacaaagacaaatggtgtttcaaaattccctttaaaaatatcaactggtctttaagtttgcatgctgcacagcatttacagaaaaaagacccgaccgtatatcagtcaggcctttcacctttaaaatatcagtttgctattttcatgaggttgtcggaaaactaatgctgttaaaatcaatattgagagctgttgctgttgttatattactagcagttgtgaaaacaactctcagctggtacgtgtttgttcctgcggtcggagctgtatctactgtagtatcagcaatcggaaacctttcagtagttgcgctaataatagatcgcgacaaaagtcttgtatgaatctgtactgctcccctatataatcttatttcaaagacaaagtttgaattggctgtagatgttacctcgacgctgactgaataatccagctttatattctgcaaagcattaactgggattgccagcgtagcaacaggaatttctgtatttaatggcgggtaaacagtgagcggcccgttggttcttgtgaagagcaaggtcggtgtactgcctgttgagcctgttgggccggttactccggttgagcctgttattcctgttgcaccggttactcccgttgggccggttggtccggttggaccggttgctcctgatgctccggttggaccggttgcacctgttgctccggttactcctgttgcacctgttactccggttgatccagttgggccggttgcaccagttgaccccgttgggccggttgatccagttgaccccgttgggccggttgatccagttgaccccgttggaccggttgatccagttgaccccgttggaccggttgagcctgttactccggttgagcctgttgaaccggttgagcctgttactccggttgcgcctgttgctccagttgatcccgttgggccggttgcgccggttactcctgttgatccagttgggccggttgcgccggttgctccagttatccctgttgttccggttggaccagttgcgccggttactcctgttgagccagttgggccggttgcaccagttgaccccgttggaccggttgggccggttactcctgttgcacctgttactccggttgatccagttgggccggttgcaccagttgaccccgttggaccggttgggccggttactcctgttgagcctgttggacccgttgggccggttactccggttacccctgttgatcctgttgcgccggttgctccagttactcctgttgagcctgttactccggttgagcctgttgatcctgttgatcctgttgaccccgttgggccggttgatccggttggacccgttactccggttgagcctgttactccggttgatcctgttattcctgttgctccagttgaccccgttgggccggttactccggttgctcctgttattcctgttgctccagttgggccggttgctcctgttgttccagttactccagttgggccggttactccggttgctcctgttattcctgttgctcctgttgatccagttgatcctgttgatccagttgatcctgttgatcctgttgatcctgttgatcctgttgatcctgttgatcctgttgatcctgttgatcctgttgatcctgttgatcctgttgctccagaagcaccgatttctcctgttggtcctgttgatcctgtttctccagttactccggttgcacctgttggaccggttgcacctgttgaccccgttgggccggttactccggttgagcctgttactcctgttgggccggttgcacctgttgatccggttattcctgttgatccggttattcctgttgatccagttgggccggttactccggttgatcctgttattcctgttgctcctgttgatccagttgatcctgttgatcctgttgatcctgttgatcctgttgctcctgttgctccagttgctccagttgatcctgttgctcctgttgctcctgttgatccagttgatcctgttgggcctgttgctccggttggacccgttgctccagttgtccccggtgatcctgttactcctgttggcccggtttctcctgttaatcccgttggaccggttactcctgttgagccggttgctccagttgatccggttaagccggttggcccggtcgaccccgttgggccggttacacctgtcgggccagttgctccggttgagccggttggcccggttgagcctgttattccagttgaacctgtcggcccggtttctcccgttactccagttgatccgatttctcctgttgcaccggttactccagttactcctgtttctccggttgggccggtcgatcccgttgggccggtcgatcccgttgggccagttgctccggttgagccggttattcctgttgggccggttgcacctgttgcgccggttgatcccgttactccggttgggccggttggacccattgttcctgttattcctgttgctccagtttcgccggttgatcccgttgctccggttggtccggttacaccagtcggaccagttgctcctgttgcgcctgttacaccagtagggccagttgctccggttgagccggttggcccggttgctccagttgtccccggtgatcctgttactcctgttggaccggtttctcctgttgatcccgttggaccggttactcctgttgagccggttggcccggttgagcctgttattccagttgaacctgtcggcccggtttctcccgttactccagttgatccagttgatccgatttctcctgttgcaccggttactccagttactcctgtttctccgattgggcctgttattcctgttgggccggttgcacctgttgcgccggttgatcccgttactccggttgagcctgttgatcccgttactccagttgatccggtttctcccgttactccggttggccctgttgcaccagtcgggccagttgctccggttgagcctgttgatcctgttgcacccgttgggccggttggacccgttgagccggtttctcccgttattccggttactccagttgaacctgttgctccagttgatcctgttactccggttgggccgatttctccggttgttccagttgatccagttgcaccagttactccggttgagcctgttgggcccgttgttccggtttctcccgttactccggttgctccggttgaccccgctactcctgtgacgccagttacccctgttgctccagttgtcccagttgatcctgttactcctgttgatccggttgatcccgttgcaccagtttctcctgttgctcctgttgttcctgttggaccggttattcccgttggacccgttgggccgatttctcctgttgatccggttgctccagttgatcctgttgctcctgttgatcctgttgttcctgttgatcctgttgatccggttactcctgttactccagttgatcccgttactccggttgggccggttgctccagttgaaccggttactccggttgggccggtttctccggttggaccggtttctccggttgagcccgttactccggttggaccggtttctccggttgagcccgttactccggttggaccggtttctccggttgagcccgttactccggttggaccggtttctccggttgagcccgttactcctgttgagcctgttgggccggttactccggttgatcctgtcggcccagtcgatcccgttgggccggttacacctgttactccggttgttccagttggtcctgttgtccccgttgcacctgttactccggttggaccggttactccggttgggccggttgctccggttgagcctgttactccggttggaccggttactccggttgggccgattgctccggttgagcctgttactcctgtgacgccagttacccctgttgctccggtggcgccggttggaccggttactccggttgaaccagttgatcctgttattccggttggaccagttgaacctgttagaccagttgaacctgttactcccgttacacctgttgatcctgttattccggttggacccgttacgcctgttactccggttgttcccgttgggccggttgagcccgttactcctgttgatcctgttgttccggtttctcccgttactccagttgggccagtttctccggttgttcccgttactccggttgttcccgttgaaccggtttctccagtggctccggttatccctgttgctccagttgcgcctgttgggccgatttctccggttgttccagttgatccagttgcaccagttgatcctgttgatcctgttgcaccagttgatcctgttgatcctgttgcaccagttgagcctgttgatcctgttgcaccagttgagcccgttgctcctgttactccggtttctccagttgcgccggttgatcctgttactccagttgatcctgttactccggttgggccggttgctcctgttgggccggttgctcctgttgggccggttgctcctgttgttccagttacaccagttgggccagtttccccggttggacctgttactccggttgagccggttggcccggttgagcctgttattcctgttggaccagttgatccgatttctcctgttgcacccgttgggccagttactccagttgatcctgttattcctgttgcgccggttgatcccgttactccggttgggccggttggacccgttgagccggttgctcccgtttctcctgttgttccagtcggtcctgttgctccggttgcacccgttgatcctgttattcctgttggaccagttgaacctgttactcccgttacacctgttgatccggttataccggttggacccgttacgccggtttctccggttgagccggttgctccggttgtaccagttgatcctgttattcctgttgctcctgttgggccagttactccggttgctccggtttctcccgttactccggtttctcccgttactcccgttgcaccggttactccggttgagccggttggacccgttgggccggtttctccagttactcccgttgcaccggttactccggttgagccggttggacccgttgggccggtttctccagttactcccgttgcaccggttactccggttgggccggtttctccggttgagccggttactccggttgagcccgttactcctgtgacgccagttacccctgttgatccggtggctccggttggacctgttattccggttagaccagttgcgccggttactccggttgcacccgttgatcctgttattcctgttgaacctgttactcccgttatacctgttgatccggttgatcctgttgatcctgttactccagttgctccagttactcctgctgctccagttgatcctgttgatcctgttactccagttgccccggttgctccggttacaccagttgctccggttgggcctgttacaccagttgccccggttgagccggttgctcctgttgggccagtggctcctgttatccctgttgctcctgttatccctgttgctcctgttaatccggttggccctgttgctccagttgcaccgatttctcctgttggtcctgttgatcctgtttctccagttactcctattgcacctgttgaccccgtttctcctgttgttccggttggacccgttgcaccggtccctcctgttgatccagttaggccagttgctccggttgatcccgttgctccggttaagccggttggcccggttgagcctgttattccagttgaacctgtcggcccggtttctcccgttactccagttgatcctgttactcccgtttcacctgttggacccgttgggccggtttctcccgttactccggttgctccggttgaccccattactcctgtgacgccagttacccctgttgctccagttgtcccagttgatcctgttactccggttgagcctgttgatcctgttattcctgttggaccagttgctcctgttgaacctgttagaccagttaatcctgttactcccgtttcacctgttggacccgttgggccggttgctccggttgttccagttgcaccagttgggccagttgctcctgttgagcctgttgctccggttactccagttagcccggttattccagttggacccgttgggccgatttctcctgttaatcctgttggtccggtttctcccgttactcctgttgagccgattgatcccgttgctcctgttgttccagttggaccggttgagcctgttgcacctgttgcgccggttgagcctgttgcacctgttgcgccggttgagcccgttactcctgttggtcctgttgtccccgttggaccggttgctccggttgaccccgttgatcctgttactcccgttgcacctgttgaaccggtttctcctgttggacccgttgggccggttgagccggttgcacctgttggaccggttacaccagttactccagttacaccttttgatcccgttacgcctgttgctcctgttgcgccggttggtcctgttgggcctgttacaccagttgctccggttactcccgttgctccagtcgcccctcttgctccggttactcctgtcgctcccgtgggccccgtcgctcccgtggggcctgtaattcctgttgagccagggtcacccccggtttgcgccaatgaaacgtcgtctattaatactgtgccagaagaaactttacttaatataatgacagcagaggctgtgccagaaggaaccgtacttgttttataaatttcagaccatgtatgaaagagcacgttcggcaaatttccgggtgtgatattttcttgaatggaactgatttcttcacctgctgcactgacaaatatgatctggagggttacctggggacttggctcatttcctagcgttgccagtgatacgaatagagtcagtgacttggctgaaattgggacaatttgactgaggtaagcatatggctgagttccaataaattgcgctgagtatctccctgaatgtgcaaacaaactgttaatctgggtatttgccgaactccatcctgctaatgtgccggtttcaaagcctccgttcataatcggattattcattcaatctttttccctctccttccagtagacagccttactttttaagacagcatattaatacgggctctcttttgacaacctaaataaaaaaggtgatttcttttcatcaccttagtccgatccttgaacggggaatcccgtcgcgataagggagccgttttccgctgtcacttgtgttacataattcgaagaaagcacggataaaaagagctggtacgcggctgtttctcccgctgccatttcgtcgatgtacgtaaaaggaattcctatgatttgcccgcctgaagaaaagaggttccgctcttgtctctgtgtttgaatagataccccatttctttgcagatcgacagctaagaccagtgagaaattagacgcgagcggatccagttccacatttacttgtatgacggcatccgtttttacaaattgatccgtcggcgcatctatcacagtgcttaacacgtttatcggtgttccttctaatggaatcgtcatttgttctgtattattttgaaaagcgacaaccggaaccgctcccggcggtccctcaggacccggaggaccgggcggacctgcctccccttgcggacctcgggagccggcggggcctcttttgccttcagggcctcgcagctggggtgcgcacaaggcggatcgattttcatctaaagacggaaactgttttttcgtcactatttccggctgttcattatcacatagtaactgttcataccagcgtttcatatgtctgctcatatatttgtaaggcttctgtttcaatatcatgtattgattacggctgctgctcatattatcaccccggcaatattgtattccaactgaagccatcatgtgctgggccttcccatcccttatagaaacaaaaaaaggcagacctgagtctgccttttttcttctaccataaacctaaaactttccaccataatccaccgatgacaagccatgtcacaatatggacgatcgacaggataaagccgatggaccaccatttgctttgtgatatatagcctgctccgaaaaagaccggagccgctcctgagccgtaatgcgtcgtcgaaccgaagaggttgctgaaaaacgccaggctgagcgctgccaatagcggcggcgcgcccgctgccacgattacggcgagaaatgccgcgtacatggcgctgatatgcgcggttgcgctcgcaaagaaataatgagtgtaataatatacgacaattaaaatcataaatgccacaatccatgaaaaaccggaaacagaagatttcatcatattgctgaaccaagacaccatgccgagttcattcaggaaattcgccagcataacaagcgccgcgaaccaagtcagcgtatcccatgcaccttgttcctttttgatgtcctcccatgttaatacctgtgacaaaagcaaaacggataatccgatcaaagccgttgtcgttgcgtcgatatttaaacttcctccgaaaatccacagcgcaagcaccaataaaaagacgatgaccatggagagttcggattttttaaacggacccatttctttcaatttttccgttgcgattttagccgcgtccggtgtttctttaatttccggcggatacagcttataaatgacgagcggcgtaatgattaagctcgccaatcccggtacaatggccgcgattgcccagcttgtccatgtgatgtccacccctgcgacatcatgggccagcttggcgatcagcggattcgccgccattgccgtcaaaaacatcgcagacgtaatcaagtttccttgaaaaccggtctttaataagaaagcgccgattttccgctctgttccgtctgccggcgttgatccgaatgtttcggataatgatctgataataggaaaaataatgccgcccgcccgtgccgtgttgctcggaatggcgggagataagattaaatcactgaaaagcagtgaataagaaaggccgagtgttttcttcccgaaccgttgtacgaatacgtaagaaattctggcgccgagcccggttttgataaacccccgggaaataaaaaaggcgatgacaatcagccagattgtcttgtttccaaatccgcttaacgtatcttcaatagacagcgttcccgttaacgcggtgactgccaatgcaaaaattgcaattgcgcccattggcaagggcttggagataaagccgataattgttgcgacaaaaatagcgaacaaatgccatgctttaggttcaagtccggacggcgcgggaataaaccaaatgattaatcccacagcaacagtaataagcaatggaatgatttttactgcctgctgtttttttgcgtctttttctgaagccattacaggtctcctcctattttgttatcttccatcccctatcccattttactacttaactaagttaataaatgtttttgttaattaaaaaacacaaaggaatattttcctttgtgtttcttgtttcttattttaatattcccgcaccggcattagatataacatcggattttacatttgatgatgagccgatggagccgtgcaatgacggtgtccagccgacggactgacttaatccgttggcggctgacgcgttaatggcggcgccgtttaaaagcgtgccgtcttcatgaagcgcttttccgccgctgaaaacgctgatgaccttatcagcagccagtcccggcacttcaaagacattattctgggcatatatttttgacgcatgtcccgcgccccatgcatagctgaacgggtatgcggcgcttttcgagcctgcgtaaaaattattataaatgtgaacctgcccgtaccggacccgcggtgcgcgctggacgatgttctggtaatagttatggtgaatggtcaccttcaattttccttcatctgacgtcttgctgtcgctgtttccgatgacggagcctttgtcatggtcatgatatttattataggataatgtcacataattcgccccgttggccatatccgtctggccgtcatggtgctgatattttctcccgtaatagtagggaaaaccgctgtcaggattcgatccgtcattaaaggtgcaatgatcgatccatatgtgcgtcgccccgttaatggtgatattgtcatattccgagttccagttgccgctgtccccgtcagtcgggtcccattgcggaaaataatcataagcgtcttgaaattcaatattgcggatgatgacattgtcgacgccattcttaatattaaaatttccgcctgtcactttggcatttgagcctgagccgatgatggtcgtatttgaagggatgtcaatcacgacctgcgctttctgttttttttgggatcgctgtctggcatcttcctgggtgcctgacggcgcttttttcccccatttagccgggtcgtacgccttcagatatgcgtttagatcatatgccggatctttataatcattaaagccgagcgttttattgttatcgtttgtattcatattgattgtgccttgtatgtaaataatcttcggcgtgctgttggcgcttccccctaatgcagaaacaagctgctttctgtttgatacggtgtatacgttggatgatgaggctttcgctcccccggttgttccgccaaaagcagctccccagccgtcatttgttcctaacgtctgccggcctaggtcagcggcatggacgtccgctgggatcatacataaacaaaccgccagcataaatagcatttttttcataaattgtgctcctcctgatttacattccaatttattgcaatcaaattgtatcaaatcagttgaaaaacagcaccgcaaatgtagtgaaggtgcctttcggttttattgcggaacccgcaaaaaaatcccaagggaccgaaaaccccttgggatctaattcagcttacgcccatgattttactttttcgttatccgtgacaaacagaagaacttttccttcatctaagcgcttttcaaattgtgatgcttcctcctccgaaaagccgatttcgtgaattttgttgcggagctcgtcgccttttttattaaacatattgccgaccgcgtgtttaatgcccgtttctttcgctccgatggtattgacatccgtattgtcggccaggcgatccgttctgtcgtcatcatgagaaagcacatatacgtcttcttttgcgacacccaattgctgaagctcttttacgtcctgcatcagtttttgatcatttgtatattctcttactaccggtttcattgataagtcctcccttttgtttttgtatattggttgtttacccgcttcatcgagtatcaaacaaaagaaagagagttccataaaaattcaggaagattgtcagtggatattttcttccgggacatgttacagtaggagaagacactttgtcagaaaaataaaaacctttacgagccgatcaagcagggaggtgcttcctattcattatttttcaccggaacagcgatttaacgcttgggttgtcagtgatttagtgaagcaggtattccgccggcatacccgctgcccggacggaataaaagagcttacggcctttgctgaagatacctttcatattaatatcgatttcgttttctctattattataaatatcggtgatatagaatccgttctgccgaaagaaattgagaatacgctcggttcttatctgaccgcgcttcggcctgtgatcaccgccgacatgcttcattcttctaaaacgaatgcctatgaatatttggaacatgagaaaaacaccgacatatatcagttattcttttaaatgacgcttatgaagaaagaagggccccagcccttcttttttttatgccggctgacggtttgattttgtattcgggaaatggttcgtgttacatttggaacaaacactcatgttgaaggaggatgtagtatgacgaaaaatcagcagcagattcaattggcaagacgcccccaaggcgttcccgtccatgacgacttccgatttgaaacgattgccgttcccgaaccgaaagacggcgaagtgcttgtaaaaacgagttatgtttccgttgatccgtacatgcgcggacggatgcaggataccaaatcatatgtcgagccgttcgctttagatgaagccataacaggcggagttattgccgaggttctgacagacggaaataagctaaaaaaaggcgatgttgtgatcgggaatctcgcgtggcaggaatattcagccgtcaatgagtccgccctccgcaaattggatacggatatcgcacccgcccaggcctatctcggcattttagggatgaccggactgaccgcttacttcgggctgcttgatatcggccgtccgaaaaaaggcgaaaccgtcgtcgtttcaggagctgcgggcgccgtcggctcaacagtcgggcagattgctaaaatcaaaggcgcgcgcgttgtcggcattgccggatctgacgaaaaaatcgcgtatctgaaagaggagcttcagtttgatgaagccattaactacaaaacggcagatgatattcaaaaagcgcttgaacatgcatgtcctgacggcgtcgatgtctattttgacaatgtcggcggaccgatttcagatgcggtgatgaacctgctgaatgaattcgcccgcattccggtatgcggagcaatctcttcatacaataccgaaagtgaagaggaagacatgggcccccgcgtgcaggcgaagctgatcaaatcaaaggcgctgatgcagggattcatcgtcggtgattattctgaccgcttttctgaaggcgcgaaacagttggctgaatggctcaaggacggaaagcttcattatgaagaaacgattacggaaggattcagcaatattcctgacgcgttcctcggcctgtttaaaggagaaaataaaggcaaacagatcattaaagtataaatcaaaaaaacggagggcttttttgccctccgtttcttatttctcagatagtcttccgcctgaatagacagcctctttcagttcaattccgagtgacttggccatttttttcagtttggattcttccatcggcgtgacaaggctgagtacggttccttctttaccggcacgccccgtccggcccgatctgtggatatacccgtcttcattcggtatgtccgcgtgaatgacatacggaagatcatcgatatcgagtccgcgcgccgcaatgtcagtggccagaagcagcggaaattctccccgttcaaacgctgataatatgtttgcccgctccatttttttcgcttccccgtgcagaatgccgagacccacatggtgatacgcaagtttttccgcatagacgcttaaattcccgatatctctgacgaaaacgagcgcatgcatgccgttcagccgtgacagcttttgcagcagcttcactttatcccgctgatcgcagacgaggtattgatgcgtgacccgcgccttttcctccgtattccgcttcactctcaaaacggacggttcgtgtgcgatcgcattcagcacctcttctgtctccggctgcagcgtagctgaaaagcttaaaagctggcggtctctcagcgtcgttttaatgatttttttcatcgtttcgcggtgttcctttgtcacaagctgatcagcttcgtcaagaacgatcgtcttgacttcatgcattttcagctttttcgcctgaatcaattcaagcacccttcccggtgtgcctgcaatgatatgcggtttatttttgagcttttccacctgctttttcacgtttgctccgccgatcaaagacaaagcgcgaagatcagagccttttttccaatcttgaatcacttggaaaatctgcatcacaagctcgcgggacggcgctaaaataatcacttgcggatgtttttgctccgggttgatccgctccaaaaccggaagcgtgtacgccaatgtttttcccgttcccgtcggggattcggcgatgacgtcttttccttccatgatcacctgagcggctttttcctgaatgacggtcggctcctgaaagcctgacgcctcccagttttcggcgataaatggttgtgtatgctgtaaaaatggccatgtttgggtcatgtcgttctcctcaattcttaaaatctactccatagtatctcaaatgcacgcgccaaacgcaattttctttttccttccaagccttttaacaaacggtctcctcctttataatcataaatgagaaagacacatgacgaaacagcgtgtctgataacgatagaggtgtaatgatgagtattttatccgtaaaagatttaagccacggcttcggtgaccgtgcgctttttaacaatgtatcgttccgtcttttaaaaggggagcacgtcggcttaatcggagcaaacggcgaaggtaaatcaacgtttatgaatattattaccggaaagcttgagcctgatgagggaaaagttgagtgggcgaaaaacgtgcgcgtcggctatctcgatcagcataccgtgcttgaaaaagggaaaacgatccgcgatgtgctgaaggatgcgttccattacttatttgcgatggaagaagaaatgaatgagatttataacaaaatgggcgaagcggaccctgacgagcttgagcagctgctggaaggtgtcggtgtcattcaggatgccctgacgaataatgatttctacgtgattgacagcaaagtcgaagaaatcgcccggggcctcggcttgcaggatgtcggacttgaccgtgacgtcactgacttaagcggaggacagcggacgaaagtgctgctcgccaaactgcttttggaaaagccggaaatccttctgttggacgaaccgaccaactacctcgatgagcagcatattgaatggctgaaacgctatttgcaggaatatgaaaatgcgttcatcttaatttctcacgacattccgtttttaaacagcgtgatcaatttgatttatcatgtggaaaaccaagagctgacgcgttatgtcggtgactatcatcaattcatggaagtatacgaagtgaaaaaacagcagctcgaagccgcctataaaaaacagcagcaggaagtggctgagctgaaggatttcgtcgcccgaaacaaagcgcgggtcagcacgagaaacatggcgatgtcccgccagaaaaagcttgataagatggatatgattgaactggcggctgaaaaaccgaaaccggaattccattttaagcctgcgagaacgtcaggcaagctgatttttgaaacgaaggacttagtcatcggctacgatactccgctgtcacgcccgctcaatctcaaaatggaacgcggccagaaaatcgccctgtacggcgcaaacggcatcgggaaaacgacactgttaaaaagcctgctcggtgaaattcagccgctctcaggcacggtggaacggggcgaacatcaatacacgggctatttcgagcaggaagtgaaagaaaccaataacaatacgtgtatcgaagaagtgtggagcgaatttccttcctttacccaatatgaaatccgcgccgccctcgccaaatgcggcctgacgaccaaacatattgaaagccgcgtctccgttctcagcggaggagaaaaagcgaaggtcagactgtgcaaactgatcaattcagaaacaaacctgcttgtgcttgacgagccgacaaaccacctggatgtcgatgcgaaagaagagctgaaacgcgcgctgaaagaatacaaaggctctattctgctgatttcccacgaaccggaattctacatggatatcgcgacggaaacatggaactgtgagtcttggacgacgaaagtgctgtaaatacaaaaaggaactcccgcctgtgcggaagttcctttttttcttaatgtccggcttttattccggcgagatgtttgcgtcccagaagcaagatcagcatacccgccagcacgaccgctcctcctacaaggtacggcgtgtgggctgtaaaacgctctgacagcattcccgcaatccacggcgcaatggctcccccgatgaaccggacagagctgtatgcagaagatgcgatggaacggtcgacaggagcggaccccatgacggctgtcgtcatgatggtgttgaccatcccgagcacagcgcctgcgatgacgatgcaagtaatgacaagcgccatgtgttctgtccaaatgcccataataaacaaaatcacggcaaaagagatgaacagaacgacgagcgaacggactgtgccgagcgctttatgcaaggccggcgctgtaaatacagacgtaaccgcaagcaataaaccccagccgaaaaagacatagccgagaccgtgctcatccagatcaagcacaaacggtgaataggcaagcaaaataaagaaaccgaagttgtataaaaacgccgccgacgccatggtcagcaatcctttatacttgagcgccttcattgcgtcaaacacaccgacgcgtttcgccggtttcggcagcttcggcagcatgagcgaaatcgcacaaagtgcgattaacatgaggacagacactccgaaaaacggagcgcgccatgagatgctcccaagctctccgcctgcaagcggtccgacggaaatccccagaccgagcgcggcctcatacaaaataatggctttggcgctgcccccgacggacactccgacgatgacggcaagcgcggttgaaataaagagagcattcccgagtccccagccgccgcgatagccgacaagctgagcgattgaacctgagcttccgccaagggcggcgaacacgatgataaaaataagtccgagaagcagtgtccattttgcgccgatccggctggaaatcgccccggagaaaaacatcataaaaccggtcacgagcaaataacttgtaaacagcagcgatacttcactaggtgaagcatgtaattgtgcggcaattgccggaagaatcggatcgacaagtccgattcccataaaggaaataacacaggcaaacgcaaccgcccaaacggctttcggctggctgaataagcctgttttctgttgtgatgatgtatccatttgatcaggcctcctatttgatccattaaaagaaacgctatatccatagcgtttacagcaaaatcattcgattgattgaatggcgcggtcagctttttctttcattccgttaaggcgctctttaaaatgcaggaatgtgctgatcttttcatcaatcatctcaagctggtgattcaaagcgtgctgaatttcttccagcttttctttccgttccttcggatccagtgacaataagtacccctctttgtttaattccagctgacggctcatctccataaactgctgaagctcctgaagggaaaaaccgagcacttcttttgtgcttgttactttttcaagttcctccatatcatcctcagagtaaagccggacgccgccttctgtccttttaggagcaggaattaaaccaatctcctcgtaaaaccgaatggttcgttttgtcaatccgcttcgtttggcaacttgatcaatcttcatccattccaaggtgaatccccctcttgtcgtatctgatactattatacaccttttgaaccttaacgtaaacgtaaacttttaaagaaaaaattttgttataatatgctatcattagatatttcgatgcgatttgtgtttaaacttggacggtttcggacgctttgctgggattgctttagacggacatgaacaagaacatatcgctcaagcggtatgttccggcagacatctgtttatgacaaaaaagccggtatgacctggggatcataccggcttttcttaattctcaagttcttcaatcatcagtgacagttcagtccagcgttccatcgccgcttcaagctcttcagccgtttttgcctgttcggccatcagttcttgaatctttccgaaatcacttcccgcttcggcgatttccgcttccagacgctgatgcttctcttcaagaccggcgattttgtcttcgatgccgtcccattcgatctgatccttatacgaaagctttttgcgctttttcttcggctcttcctccgcctttttctcttcagccggctgttttaccgacgttttctttgcttttgcatattccatgtattcgctgtacgaaccttggaaacgggaaatgacgccttgcccttcaaatacgatcaggcggtcaacgactcggtcaaggaaatagcggtcatgggataccgtgatgacgacgcccggaaactgttcgatataatcttcgagcacgcttaatgtttctgtgtccagatcattggtcggctcgtctaaaaacagcacattcggctcctgcatcagtacattcagcaagtacagacggcgcttttccccgcccgacagctttctgatatacgtctgctgcatcgggcgcgggaacagaaagcgctcaagcatttgttccgcggtgatgacatcgccctccgccgttttgacgatttcagccgtctcttttatatattcaatgactttcatatcaccgttcatttcactgtgatcctgggtgtagtagccgatccggaccgtctgcccgatggtgatattgccgctgtcaggctgaactcggccggcgaggctgtttaatagtgttgttttcccgattccgttcggcccgatgatgccgattctttcccccgggatgacaagctcgttaaattggctgatcagcgcttggccgttataagtaatggtgacgttttccgcttcgatcacctgttttccgagacggtgggagccgatcgcgaaatcgagcgatccggagactgccggccctttttgctccttgagcgcctctgctctgtccactctcgctttttgttttgtcgagcgcgctttcgcccctcttctgagccatgccaattcgcggcgcagaagattttgacgttttgtttctttctgctctgccagtgcttcccgttcggcccgcttttccagaaatacttcatagtttcccttatacgtataaaggctgcctctctcaagctcgtaaattctgttcgtcaccctgttcagaaaatatctgtcgtgcgtgacaagcatgacggcgcccggatattgcgataagtagccttccagccattcaatcgtttcattgtccaaatggtttgtcggttcatccaaaatgagcaggtcagccggctggatgacgtttttcgcaatcgcgacgcgctttttctggccgccggacagctcgctgacatccttcattaaatcggtaacgccaagttttgtcaaaaccgttttggctaacgtattcgcttcccatgcatcattcgcgtccattctggcctgcgcatcaagcaggtgcttctggcgctgttcattttcaggctcttcattcagcgcctgaagcgctttttcatactctctcatcgttctcatgactgccgagtcgccggaataaatatgttcaagcacggtttgtccggcaggaagctcggggtcctgatgcaaaaattcaatatgcacgcttcctgacgccgtaatctcgccttcttccgttgattcaaggccggcaatggttttcagaagcgttgacttgcccgttccgttcgggccgattaaaccgattctttcattctcttcaatatgaaaggagatatggtcgaataatgtcttatctccgtatgttttataaaggttttccgcttttatgatgctcatggttcctatcaatcctcacgtaagttcatgtgttcattttaaatcaggcgctggaataaaactagtaaaagggcagacaaatttcttggaagagatcattttgtccgaagaatgtttccgcctctccttttatacactggaggtgaagaggtgatgacatgatcagcgtcagtttgtgcgttattgtaaaaaatgaagaggaagtgcttgcgggctgtcttgattccgtcaaagacattgcggatgaaatggtgattgttgatacgggctcaaccgaccggacgaaagaaatcgcggcccgttatacggataagatttatgattttgaatgggtcgatcactttgcagccgcccggaattttgcgttttccaaagcggaaatggattatattctgtggctggacgccgacgatatttttttggaaaaggaccgcgaaaaactgcttgaactgaaggcgtcactttcaaaagaagttgacgcggtatccatgtattatcacgtcggctttgatgatcggggagaggtcagcttcagataccggcgcaaccgtctcgtcaagcgggaaaaagggtttcactggatcggagccgtgcatgaatatctggaagtatacggaaacatcatagaaaccgagatcgccgtcacacaccgcaaatccgagaagcagcattcgcctccctcagaccgcaacttgaggatttacgagaaaatggcggaaaacaatgaaacgatgacaccccgcgatttattttactttgcgaatgaattaaaagatcacggccagtatcagcgcgccattacgtattatcaccattttctttccacaaaacagtgctggatcgaagatgagatcagaacatgccaatacttatccgattgctacagggcggtcggccatgaagaggcagccatgacgtctcttttaaaatcatttttgatcgattgcccgcggccggagttctgctgcaggctgggtgacttttttgctgagaaacggcaataccggcagggcgtgttttggtatgagctcgccctatccgccaaaagcagcgatgcaggctttacccagctcgagttctccacctggtatccccatctgcagctctgcgtctgctactggcagctcggcgacagagaaaaagcgaagattcataacgacaaagccgcctcctaccacccgtcacatccgagcgtactgtataatcaaaacgtgctcggcacataacatcaaaaaaagagctgccccgtatgaagggcagctccttattgattacgctgtcggaattcctccgcttacactataaatttgggatgtcacatagctggattcctctgaggccaaaaagacataaatccccgcaagctccgccggctggccggcacgatttaatggaacggccggtgtttccttgccgaatttcggaatgttttcaccgcgctgtcctcccgaaatctgcagcggcgtccagatcggccccggcgctaccgagttgactctgattcctttattcgccagctgctttcctaagccgacggtaaaaccgataatagcatgtttcgtcgcggcataatccaatagcatcgggcttggattatacccttctacggacgttgtcgtgataatagacgcgccttttggcaaatacggaagcgccgccttgacgagccaatacagtgaaaatacattgacttcgaaggtttgatagatttgttctgtggcaagatcgctgatatcatccactgcctgctgtttgccggcgacaagagcgagcgtgtcaagaccgccaagctcttgatacgctttttccgccaattctccgcaaaacgcttcatcgcttaaatcacccggcagcagaacggcttttcttccttctttttcaattaatgcttttacttcttcggcatccggctgttcctcaggcagatagttaatggctacatccgccccttcccgggcataggcgattgcggcagcccggccgattcccgaatcgcctccggtaacaagggcttttcttcccttcagctttcctgctcctttgtagcttgtttcaccgcagtccggcacaggcttcatctctttctgcaaaccgggcggttcctgatattgttttggaaattcatcatggtcatatttcgtctgcgggttgtgcagatttgcatcagacatacaaaactctcctttatcattggtgatgtattcgtatgtgtacccttgagcatgacgggtcaaacgtgtgaggagcagtttccgaatgctaagataaaacaaaaaaaggagcccgtaagctcccccccttttttatgaatctccgagcacgttttcagccattttcgctaaatgctgggcgcttcccgaaatttcctgcatcgttgcagaaatttgttcaaccgccgccgcttggccgtctgtgttctggttgatggattcaatagaatcctccagccctttcagcaggctgtggatttttttcgtaatctggtcaatttggccgacattgtcttttgaatgagtggcaagcttgcggatttcgtccgccacaacggaaaagcccttgccggattctccggctctcgcggcttcaatagccgcatttaaaccgagcagattgctttgatctgagatgcccttgactgtgacggagatgtctgcgatttctcccgcgctttcactgacttgtttcgcctgagcggaaatcccggacatctgtgacgaaaagccgttgatggattctgaaatatccgcgaccgctgaagccgtctgttccacgacggcggacaggctttcagcgacatcatgaagcttggctgatttttcaaggctggtgccgagaccgacgccgccgataacttttccgttttcatcgtgaagcggaatcgctctggcaatcagcggaaatccgaacagctctttcggcaccatgcttgtcttcttctgattcatgcggatcgcgtctgtaatgatatcccctttttgcagcgggtcgcccggctttacgttaagagaaaaagttttagccggaatgttcacgattaatttttccgtatcataaatcccgatggtgatgtcatcttggatcagactgtttaaaaaaggcgcaactttgacaaaagcgtcaagcaggctgtgcgtttgctgctccgtctgtatactcatttctttcactccttcttaatatgggaattgccgtttttcatgctgaaccgaaatccatttcagcgtggtgaattcttcaaggctccattcgccgttcagcctgccgagacctgattgcttctcgccgccgaacgcgacattcggttcatcattaatggtcgtatcattgacgtgaatcatgccggtctcgatccgctttgcaaactcaacgccccgctcaacgtttgccgtatgcacggctccgcttaaaccgaacggtgtcgcgtttgcgatgctgacagcttcatcctccgtttcaaacggcatgatgcagacggccgggccgaacagttcctccttcgcgatgctcatatcaggcttcacatcttttaagatgacaggttcagcgatcgttccgctgaatcggccggacaagaccggaaccgctccctcttctatcgccttttcaacagaccgttttaaaccttccgcctgtctctcattgattaaaggcccgataaccgtatcagggtccatcggatcgccgactttcagcgatgacactttcgcttcgtaaagctctgtaaatttgtcatatacagacgtgtgaacgagcacgcggttcgccgacatgcagatctggccctgatgcgtaaaccggctgaatacggccgcattgacggcgtattcgagatcagcatcctcaagcacgatcagagcgctgtttccgccaagctccaacagcggttttttaaagtgtttaaccgcaagctgtccgatatagctgcctacccctgttgaacctgtaaatgagataattcgcggcacgggatgctcgacaaagctgtcgccgatctccccgatatccgtaacgatgacgttcagcagcccgtccggtacgccggccgcttcaaaaattttcgcgataagcgtgccgccgcagatcggtgtttcttcatgaggcttcaatacaacgccgttccccgcgccgagtgccggcgcaacagatttcattgaaaggaaaaacgggaaattaaacgggctgatcaccccgacgactccggcgggtattctgtacagcctgttttcttttccgtcaatcgtcgacgggagaattttcccttccatccgcaccggaaatgttgcggcttcttttatcatatttttaacaagtccgatttcaaactcagccttcagtcttgttccgccaagttcctccatgattaagtaaacaatcgcttcttcatgctcttcgatgaaagataccgctttttccaaaatggcccgctttttaaaagggtttactttgtcccattcttgtttcgcaagagccgcggcacggtacgccgcatccacatcatcaggcgtcgcttttcggaatgaggtgatgactttctgagtataaggatttctgtcttccaatacgttccggctgcttccatccctccatcggccgccgataaactgcttatttagttcttcatattgaaacatgtaaacatctccctttcaccgaaacttgaaaatagttaatgggtcattttttgtatcggtcttaacgtgagaaaattgaactatttcacgataaaattactttctcttcctcacatcgacgcttttgagctttgtccttttaaagtggaaaattctttaattgactgcgcgaaatttcaacaatataatacaaacgtcagtgtatataatgatgagaatattatgaattttcaggaggacccatatgtctttactatttcggaaaaagccgctggccgacttaaaggcacagagcagacagaccagtctggcccgctcgttaagcgcttttgacttggttttactcggaatcggctgtgttgtcggcacggggatttttgtgattaccgggaccgtggccgcgacaggcgcagggccggctttgattctttcgtttgtgctcgcggggcttgcctgcgcgctcgccgcgttttgttatgcggaattttcttcatccattccgatttcaggcagcgtatatacgtactcatatgtcaccctcggggaatgtctcgcgtttttaatcggatgggacttaatgcttgagtatgtcatcgcgctcgccgccgtcgcaaccggctggtcatcgtatttccagtcgcttctcgcaggcttcgggctgcatcttccggaggcgctgaccgccgcacccggaagcaaagcgggcgccgtgtttaatctgccggccgttatcattattttggtcattaccgcaattgtttcaaggggcgtgaaagaaagcacccgctttaacaatgtcattgtattgatgaaaattgcgatcattctgctgtttatcatcgtcggtttcggctacgtgaaaccggaaaactggtcgccgtttatgccgttcggaatgaaaggcgtcatcgcgagcgccgcgaccgttttcttcgcgtatctcggatttgatgccgtgtcaaacgcgtcagaagaagtgaaaaatccgcagaaatcaatgccgatcggaatcatcggcgcgctcgccatctgcaccatcctttacattacggtgtcgctcgttctgacaggaatgcttccgtacaccaaattaaatgtcggagatccggtatcctttgcgctccaatttgtcggccagaacaaaatagcgggcattatctccgtcggcgcgattatcgggattacaacggtaatgctcgctctgctttacgctcaggtgcgccttacatttgcgatgagcagagacggccttttgccccgcatgttttccaaggttcacccgcgctttaaaacaccgtttcaaaacacttgggtgacgggaattgtcgctgccgggatcgcgggttttattgatttgggaaccttggcgcaccttgtcaatatgggcactttggcggcctttacggtcatcgcgatcgccgtcatcgttttaagaaagaaacatccggagatcacatcttccttccgtgttcctttcgtgccttttgtgccgatcatcagcgcatgcttatgcctttatctcgcatgcagcctgccgggcgtgacgtggctctcctttgtcatctggatcgccgccgggatcgtcgtttacatggtgtattcgagaaaacacagtttgttaaacaaataaaaagggaggctcttttttcggtttgagaaagaagagccttttttgctcttgataattcattcaccttatgaataatatggtgtatgcttcgcttacagaaaaaggaggagaataactgtggcaattgccgccccgctgaaagaaaaacctgtccaacgtcccgagacaaccatgtattccattttattgattatcgggatctgtcatttgctgaacgattcgctgcaagcggtgattcctgcgatgtttcctattttggaacgttccatgagccttacctttacgcagctcggaatcatcgcctttacgctgaatatggtgtcatccgtgatgcagcccgtcatcggctggtatacggataaacgcccgatgccgtatgctttgccgctcggactcacctcaagcatgctcggcattttaggcctcgcgttcgccccgtcttttctgacgattttatgctgtgtattctttatcggccttggctccgccgtctttcatcctgaagggtcgcgtgtcgcttacatggcggcaggcaataaacgcggcttggcgcaatcgatttaccaggtcggcggaaataccggccaggcgatggcgccattgattaccgcgctgattctcgttccgctcggtcaattcggttctgtctggtttacgcttgtcgccgcaatcgctgtgctgtttctcatttatatcgccaaatggtacaaagaccgcctgattcatttgcgcgccgcaagtaaaaaatcgccggccgccgctgtacagaccgtgattacaaaaccgattattcttgcccttatcatgattatcttcttaattttcgcacgctcctggtatgtgagtgcaatcggcaacttttatacgttctatgcgatgaatgcttatcatgtcagcattcagcaggcacagagctacatcttcgtctttttatttttcggcgctgtgggaacgtttctcggcggaccgcttgcagaccgtttcggaaagcggaacgtcatcatcgtttcgatgatggcatcggctcccttgacgattttccttccgtttgcgggccctgtcatcgcttatggcgtactggccctgatcggcgttgtcctgatgtccagcttctccgtaacggttgtctacgcgcaggagcttgttccggggaaaatcggcacgatgtcagggctgacggtcggactcgccttcggaatgggagcgatcggagccgttgcgctcggcgccctcattgattcggcgggattaacgccgaccatgacagccgtcgcctttctgcccgttttaggcctgctcgcctttgtcctgccgagcgacaaaaccttaaaagaatggcactcataaaaaaatccctgccaaaaaggcagggatttttatgtttcaaccgtataaaaatgagtgtcaggaaccgcatatctcggaataaacccgtctctgaaatctgggaacgcttgttgaatttcatcaatccattttttaatatttttgatatacggcacgtaaatatagctgactgtcgccttgtcatcgatgtgatagtaccagcacagattgaattcgttctccgtgacgagtgtaaaaccggaaaaatgataaaaaatcagcggggtgtcattgacatatacagctccgtcgcgcaggctgactttatatttctcaatattccacagcgccgcattcgcgccgatcgactccgagacatggacgtgttcaaattgcgcgggccacttttcaacatacctttgatcaccgtatgtctttttttcttcattcatctccacggtacaataagagatacaatcctgtctccattgccagaccgcccggtacgcttcctcagtattccgcgcgccgacaaacccggtgttgtactgcccggtcagcttgtaataggacgcaaaccgttttgaattgcggtgatccgtcagaaaaagagaagcatccggcttttccgcaaacagcctatccacatctgagaagaaaaagagatcggtatccaaatgggcaaaatattcggcttccttatactccgtcatcacatggaacagaaatgccggcttcagcgtccagcaatattcatgaaacgtccggccgccctttgcttcaagcagctccggatcctccatttcatggagctgaaccgccgtgacatgctcccacggcacctgctgaagcagttcatacgccttcaggtcgacacacagcacatacagatgaaaatcacggcaatgctcatggagagaatgaatcatcggcatcagtttaaagatatgcgttcttgaaacaatggttgaaaaatgatatttactcaccatatcacatccagtttatttaagatccacatgcagtaaatcagcaatcagcgctttgaacgccctggcaaagtgcgtgacgcccagctttttttccgcttttgacaaaagcttttggacctccggcagatgaaagctgttcgccgtgatacgcgggcttttcgtcttccagtccgggtcgaggttgcggtctttaaccacgtgcagcagctcgagaaagatgtgcagcaggctttcatatttctcataatcaagcagtttttcgatgtctgccataatgctgttggtcaactccgcatcaaatgggccgttaaacgcgaggtgcacgtcaagcgaatgaatatcattgtacttgtcgcacatgtacgcgatattcgtcctgatgtcatcaacggaagcgcagttgctcggatgctcctgatggacgctcatgatatcgcgccgcagctgaaacgccaatcccgactgatgaagcctgatgccgagatcataatcctcaaagccgtatctgacaatgccttcatcaaacaggccgagatcttccacgtgctgtcttttcactgatgaattgttcgtaatgaaaaaacgccacggcagacggtagcctttcaaatcgtccccgtattttcccaaaatacttttcagcgcgcggataaaatcggtatctaagtcaaagcattggtcaagaaagcttccgtctctgatcgcactttcatcaagaagcggctctttatctcccggcagatcttcatacagttcggctagcttttccttatgctctttttcaaagcggtcataataaaagctgtacagccgcttccagaacataccgcaaacgacaagatcgtcccggttctcatgagccttgatatgcttagccaccaaatccttttcggcaagcatgtcactgtcatggaaaatcaaaatatcgcctctggcattgcgaaccgcctgattccgtccgtaagcgatccctctgttttctttaattctcacaaaaatcagcggaaaattcgcgctgaatgattcaagcatggataaggttccgtcttctgaaccgttgtcagccacaattacttcgaacggctctgtgcattcctgttcattcagggagagcaggctgttatacagcctctccttggaattatatgcgggaacaatgacgcttgccttcactttttgttcacttcctgtatatgatcatttatttgttatcatcctcagatgcaaagccgctgaactccgggcagacggcgctgaccgtcccgatcacctgcttcagaatgtcctggtaaagctgatggacaaacggcaggtcggtccgggtcgtctcgtgaatctgccgaatgtcgttggctgtgacgatccgatatccgctgaaatgatagaaaatcagcggacttccgtcttcgagcacaaggcgcccgtccttccatgaaaacgtatgccgtccgtaattccaatggccgatattcacgccgggcgtggcaatgtcacacacattcgggaacagatcagacatgtaatccaaatagccctgatctccgaattttccttcccccggcgcatttttgcattcttccaggcaacgttctttccaccacttgagacaatctgtgccggcccggtcggctttgaagctgagaaaaccggaattataccggcctaaaagacgctgcagcatgtcaatttcctgtttttcaaatgaggggatgacgatatcgccccgtgacagaagcaccgaacaatccggctgattttcaaaaatcgggcgcggatcagcgaagaaaaacaaatcggcatcaatgtacgtgacacgctctaagtccggatgtccgtccagtacgaattcgagaaataccggcttcaccgtccagcagtattcgctctgatccctcgtccgcttcagttcaaggagctcctcattttccagtgccgacacctgaatcaaggtgacattatccggccgcattgcttgaagcacgtcataggtgtcttgatccatgcacaaagtaaaaatgggggcgtccgcctgaacctctttcaatgagccgaataaagcgatggcctgatatagccttccttttgataaaactgtgcaatatgcgcttgtcacgtctttatctcacctctgtttttgttacttttgaaaaaaggctttataccattcaatcgttttttccaatccttcatcaatggcatgcgcgggtgtccagttcagaagcttcctcgccttttcagccgataaatattgatgcttgatttcgtggcttccctggttgagcaccttcggcttcagatcactgtccatggccttaagaattttttctaccagttccagcaccgtcagctgaatctcattgctgaagttgaacgcttctcccgcaagattgagctcctccatcttttccgccagcaaaaggtatgcttcgaccgcatcctcgatataaaaataatcacggataaatgtgccgtcgctgcggatttccggcgcttcaccgttcagcacgagctgaatcgtctgcggaatgatccggttgaaattcaaatccccgccgccgtacaaattgccgcagcgcgtaatacagactggaaggccgtacgtattaaaatatgtgtggcttaacagatcggcacagctttttgacacgtcatacggatgtttgccttgaagaggcatgttttcatcgtacggcagtgtcggctggtcgccgtatgctttatcactggaagcgacgatcacacgcttgataagcggatgtctgcggcacgcttcaaggatgttccatgtgccgagaatattggcttcaaaagtggaaatcggattgcggtttgcgacaccgacgatcgcctgagcggctaaatgaaagaccgtgtcaatttcatattcgccaagcgcccgctcaatcacatccagatcttcaagcgcgccctgcacgatattcatttgcttcacttgttctccctgatacagatttgatttgggcacagtgtcacggacaagtcctgtcacattggccccctgatcgatcagttccttcaccaagcagcttcctaaaagacctgtacatcccgtcacaaacacatttttatttttccagaaactcaaacctgatcaccataccttccatacatgttgtccttgatcccacatcttgttgatttccagcaggtttttatacgtatcgatcgccgtccagaatccgtaatgccggtatacagctaattcgccggccttcgccagctccttcagcggttcttcttcaaacatgacatccctgtctttcggcagataatcgaataccttcgggctgagcacgaagaatccgccgttgatgatgccgtcgcttgaggttttttcagaaaagcttttcgccatgccgtcttcgactctcagcgtcccgaattgcgaggtcttctcaataccggtgacggttgccgcagccccttttgattgatgatagctgatcagatgaaacatgttgatgttggccagtccgtccccgtacgtcattagaaaggtttcatccccgatgatgtcctttgcctgtaaaagccgccccgccgtctgcgtgtgttcccccgtgtctaaaaaagtaattttccacggctcggattttcccaatatccgcacttctccggtagagctgtccagcgtcatgctgtgattcttccaatcataatctaagaaatattccttaatcatctctcctttgaaaccaagaagcaggataaattcgttcacgccatagtattgatagagtttcataatatgccatagaatcggttttccgccaatcatggcgagcggtttaggacgttcattggtgatttcgctcattctcgttcctttcccgccgcagagaatgactgctttcatctctacccctcttctctgtgaatattggattcgaaaccgcccgtacaagagaaacccaacccgataatttgtccgattctctattaccggtttcaaaatctactgtaagatatgagagattggcgccctttgtgaccaaaagctctcccttttttcagattagtgaagatacacacaaaaaaaagaaccttacggaagatattccgcaaggttctttctattatttattatcctgattgagcttttctttgccgtaatgatattttgacggatcaaccggcgtaaagtcgttcattttgtggaatctgagcaggtctttgtacataacgctgtcagacagcttcagctgctctgtgactctggctttcaggtttttcgtttcctgattgcctttcagttcttttcctgtcttcgtatcgtatacgacattggaaatagaagtatatttcggcgtgacgtaatctccgttacggaacgtcaccgtgtcatcatggtctttcgagaagagatcggtaccgaaattaatatatttcttagaatcgatgccttctaagtgaaggatcgtcggcattacatccatttcaccgccgtacgtatggttcactccgccttttttgccagggacgtgaatcataagcggcacacgctggttctgcgcgttttgataaggcgtaatttctttgccgagaatttctttcatcgcgcggttatggttttcagagattccgtagtggtctccgtaaatcataatcaccgagttgtcatataaaccggacgatttcaggtctttaaagaactgttcaagcgcttcgtcgagataacgtgcggtctggaaatagtcatccacagtcgcgtctcccgttttcgctttttcgatcgttgcgtctttttcatcaagcgtaaacggataatggttcgtcagcgtgattaaatgcgcatagaacggctgtttcagcgattgaagcttcggaatggattctttaaagaatggtttatccttcagtcccatattgacaaggttgtcgtcagacatatcgtatgtgctggcgtcaaagaatttgtcatagccgatatgtttgtaaatctggtcacggttccagaatgatttgtagtcaccatgtaaaacggcgcttgtatagccttcactttggtcaaggatggcaggtagcgattgatacgtgttttctccttttgtcacgaaggctgacccttcaggcagtccgaacaggctgttatccatcatcagctctgcgtcagatgttttaccttggcctgtttggtggaaaaagttatcaaagtacgtcatgtcttctccgccgcgggcgagtttattcaggaacggcgtgacttctttaccgtcaagtttgtaattgatcaaaaacgattggaaactctccaagtgaatcttaatgatgtttttgcctttagccttgccgaaatactcggcgtccggcttcgcgtaatgcgacgatgtgtagttttcaacgctcgtcaggtcatcgctgcttgcatatgcccgctgcgtttccgtctgtgccgtctgcacgccgtcataaatcgtgtaattataaaggcctaagtatttcacaatgtagttgcggtcgaatgttcttgtcaacagctccgggcggtcctcttcggcaatcgccaagttaatgaagaacaaaacgatacccgtaacgataattaatgacgtataacgttttttcagcttgaattccttcagctcacgtctccacaccagcagtgcgattaaaataataatgtcaacaaagtataaaatatcatggccggacataatgctgaagatgccgtctcccatatttccgacattaccggattgctttaagttagggaatgtcaagaaatcatcgaagaatcgatagaataggatatttgcatacaaaataaacgtcatgatgaaatcaataatcaccataataatcgctgatttgcggcctttcgcaaacaatgccagtcctaaaaagaaaatggcgcttgagaacggattgatcacaagcagaaactgctgtgtcggccccttcaccccaaggttgaattcagcatgataggctaaatacgttttggcccaaaacaaaataatagccagtacaaaaaaactaagtctgtaagaaaataatttcttcatggcaacctctactttcctaaacactttaaatctgtattcttactttttgcttcaattcctgctttccgagcaaaacgaaagcatcacacagccccataaacacaccatttttaaaaacgatatatttatcattcgtgtcatgcccattgaacatcttatcccgccagccattagacgcaggatatccgttcttcgtttcacatttttttctgacattaaaaggataccgtatcaaaccgggtctccaaaatatgagataccaaatataagaataacacaaacttgtaaaaacgaaaaatgaatatcaaagacagccgcccaccaggcgggctgaagttattgtatgcaaagggtttgaaaaacttgaaggtttttttcggctgatgcaaaaaaaggactggagtgatccagtccccatatgcgtaatttttaaattcccgcccagacatcttttgcataaatgccttttgtctggagatccaaaagccactcttgtgcttgccgttcatctgttccgtgagccgactgatatgctttttgcagcgtttcctctacatcaggcgccatcttgcttccgtcgccgcatacgtatagatgccctcccctgtcaaggatcgaaattaaagtttcggcatcttccgccattaagtgctgcacatacgttttcggtacgccttctttgcgggagaaagccgtatgaagcgtcacgattccgtctttttcataagcttcaagctcgtcacggtaaataaaatcataatcgtttctgcatccgaagtagagatgggcctcccccagctcttttccttctccttttaatgccgcccgcgcctgcaaaaatccgcggaacggggcgactcctgtgcccggaccgaccataataatcggtttttccggatcttccggaagccggaattttgtttccggcgtgcggacaaacatcacgataccatcgtcaggactgcgatccgccaaatagttcgaagcgactccgcgatactcccccaaaccgctgcgggcggggccgcgaacgacgccgacggtaattgaagcctgcccgggatgtttcagcggcgagcttgaaatcgaataataacgcggtttcagcggacgcaaaagctccaaaaatcgttcaaacggaagctcacacgcttcatatttttcaaggagatcgagcattgagacgcgcaatgtcaggatttgctcctgatagacaccctcctcaagaagaccttccaattcatgtttgtgcggcgggcagacagtataagcggccatttcacggatttgagctcttgatgccgcttcctgcaattcgacgcagctgctcagaagatcgtgcagcctgaccggccgatcgagcgggagatgagccgcgctctgtccgctggccgtcagcagcacttggtcgttgccgttcagattgtaccggcggagaacacggctgacctgctctttgctgtttacaggcagaacgccgagatgatccccttcattgtaagcagcctccttcggcagaatgatttcaatatgccttgtgcttctatcgctttccggcgcttggagctccctgttttccgcaacggatgcgtaaaccgcttcatacgtctgagccaagggagagccgccaagcccgctcacaaattgaaggcccagcgtactccgctctttttcggcattttcattcagcttgagaccgaacgctttcatggcgtccttccacatactttttttccattcatcaagctttccttcaaaatcgccgctgacatcaccttcacctcgtgaggaaaagcgttccgcccctttttcagcaagcttttcatcaataagtctcggaacggcctgatatgtcgccgcccagttatgatcaccgcagccgaagacggcatatcggacgccttccaattccccttgtttgacttcttcaagccattgaacgaattgtccggcgttactcggaggctttccgttataagaggacgtaatgatcaagagagctccttctttcggcaattttccgatccggtcattcaaaggtgccgtttcagtccggacgccgtgcatcccggcagtatcggcaagctcccacgcaacgccttctgcggttcccgtatctgagccgtacagaatcagaagcggtcggttgtcaagcccgataatggaagcgccttttgtctcctgtttttcttttgttacgtcttccgccgctttttcagccgccgtgaaagccgccggaacggcttctttgctccgcggccgcacccggatatgaaagtcgttgggcttgagcgttaacgtctgtttaatatccagctcataatcggtatggtctgtaaaggtaaaatgctgaagaatcatccccagtacaagagtcgcttcatgcagcgcgaactgcatgccgatacacgcccgctgaccgtttccgaacggcttgtacgcatggtggggcacttgatcaggatgttcaaaccgctccggataaaattcctccgcattgtctccccacgcgtctttatcacgatgaagctgaggaattaagacggaaattctgtcttttgtcgtgatcggatatttcccgccgatcaccgtatcctctttcgcataaagactgaacgcaggcgcggtcggccataagcgcaatgactcctgcaaaatcatccggatataggtaagctccagcacttgtttatacgaaggaacgggatcggtcaatacccgatcagcttcctcataagctttttccaaaacgcggggatgcttcagcagaaagtagatggcaaaggaaagcaggccgcttgtcgtttcatggccggcaattaaaaacgtgatgatttgaaagcggatattttcatcatcaagtttttcacctgtttccgggtcttcaacattcagcatcctggccagcagatctttttcatcccggccgccgtctgacctgcgctctgcgataatactgtctaccaacgaaaacatcgcctgaatatcatgatgaaattggcgcttcgtcctgatcatgagcttatcctgaacatcaagacgctgcatttggtgcatcgcttcatcaagtgcgcgcaccatgctgttaataaacggatgaggcgtttctctgtaatagctgttaaaccgatagttaaaaccgcacagtccgatcgtatcgagcgtcagccgggtcatatcagcaggcacatcaacggcctcatcaggattcagccttgcccatttttgaatcagctgcaccgcgatatcagtcatcatcgaatgataatctttcatcgcgcgcttgctgaaggtcggcatcagaatattgtgcgcctttcgccagttaggctcgtgcgtccagcttgtaaacagcccgtcaccggaaaacgcgcggactttttccaaagccccttcaatacttttatcaaaccgctcttcgtcacaaacctctttcaccagttcatggccggacacgacgataatggtgcccgccggtgtatgcagctgaaaaatgggcccctgctctttggccagtttgataagcgacattgtgggcttgtctttatcaagcaaagggagattgccgagcggcccgaacgtcttcggcttcggaatcggacttgtttccttcatttacaacaccctttcttaaacgttgatgcgttccttccaactacagtgcccttttcaccggccgattatccgccaggacggatcaatcctctgattgacgatcgattacggttttttctatactggagaggcttgtcaaatacagaaataaggtgagttcacatatggattttgaaatcaagtttttatcgttttatgtcattcaagtggaaggaaaagacgatcaggcaaacaaacagttcaaacatttccagacgcttgatacggaagaatttgaagaaagcgagctgaaggattttcttgacggggaattgaagaaaatcgtcaaacggaaagccgaacggcacccgcaatcagagcaggtccccacaaaaatcggccattttatcacggagccgggtcatgagcttgattcaaatccgaattacaaccttttcaaccgcgcccggcttgcggatacgaaggaagcatttatagaagcaagtgagcagttcgtccgcacgtacctcgatacaagcgccgttcgcggcggtgttttcattgtggcatcggccgtgccccgcaaatattttgaggacaaattcgtctttatgatgaaatgcgatttcgagccgaaggtcgcccgcatctcagacgccgcgtctctcattaaaaaagtcgaaatggccatcacgacaaagaatatgaaaagcattcaatatccttatatgccggaagaaggcatgaccgaagagcacgagctgaaaatccatcaggcctcgcacgcccgttatttcgaggattttctcaaatttgtcgaatacggcgaatcgatgccggaaatcatgaaaaaccaagtcataaacatggtgcaggaacacgtgtatgaaacctttgaagaaaacagtgaagagcttcagcagtttgagcacgacatcgaaatttgggaagcgagtgaaaagcgggaaattcaggagcgcctcgacacccatcaagtcatcgaggcatccgcgcagatcattgagcatacgcctgaggccgagctgaaaatgaaagtcggagaaacagagattaaaggactgctggccgatttcggcgaatccatccatctcgcgaaagtgaacggacgctatgtcgcgctcattgaagcagaaacgatttcgtttgaaaaaggcagttcaccggtggagtttcacaagcctgaggggctgcatgaggtgattgagcggatccggaataaatctgaacaagactgacaaaagtccagacgccatgttctggactttctttatttaataaggctctttgagcagccgatggcattcaccgatgatgtcttggacaccgggtgttccctttatctcgcggcggacgatttcagatgacagattctgtatctgtaaagcccgctccgcccgtctttcgaagtatgcttgaaatgcagtttcatggttttcatcattttgcagtcttcactaagaacgatcgcgtcttcaatcgccatcgccgctccctgcgccaatgtcggcgctcctgcatgaacggcatccccgcccagaacgacgcggcctctgtgccacggttctttgaccgccatctgctcaattttatgaaacaaaacaggatattcctttgacatattctctgtcacaaacttcactcccggaaatccgtgcagcaggtctttcacccgttcaaaacgtgtatcctcgtcatccgtacagtcagcgtcatacggccggatgataaatacgtatcctgttttttcggacagcggcacgacaccgacctgcgtctgcccctttttatacatcagtgtcgaatcatgaaaaacccgctcgggaaaagagatgaaaaatctgtgcgctcccatgccgagatactccgttttcacttctctttgcagcatttgatcacggacaacagagcggatgccgtcaaagccggcgagaatgtccgccgtcatcacggttccgtctgcgaaatgcaccgttatttcatccgccgtttcttcgtaagacacgacttttttccccagcaaaatcgtggcccccgccgcttcagcatgctttctgaggatatcatttaacgtttgccgcaatatattattcctccccggcaatgaatcatctaaaaacgcctctctcactttaaacaataacgacccgttttcatcatgctgcttcagccattccgtttgaaaaccgttttggcagcattcttcatacacaccgatttcacgcagcaccccgagcgcattttgaggctggagaatgcccgctccgcttttacgcatttcagaagccgcctcgcaaagggtcacttcaaaccccgctctcccgagagaaatcgctgcacacaggccgccgatcccaccgcccgctatgatgatctttttcacttcatggttcattacgataccgccttcttatttattatctattaactattagccaccttactatattggctgaaaaactgtcaatctttataggttgccttttgaatccggcaggcttatactttgaatcactaaaatggtacggaggcttacaaaaatggagttgagacatttgccggattactcgcagattgccggacacgctgagatttacgccgatatggatgctgaatcattgaaaacatttttgacgttattagatatgtcgaaaaaaatgaatcaggtcatggagcattatttctcaagtcatggactgtccgaaggcaaattcaaaattttgatgtttctgtttgacgcgcccggccacagcctgagtccgacggagctggcgaaagaatccaatgtcaccaaagcgaccattactggattgatcgacggacttgcccgggacggctttgtgaaccgcaggcggcataccggcgacagacgaaaaatcagcatcgacctgaccgaggaaggaaaagaaaagctgatgcggtttcttcccggtcatttctccaaaatttcaggtgccatggaaagcttcaccgcagaagaaaaagcggaattgacaaaaatgcttgaagttctatttgataagcttctgctgttttccggcggcagaacataaaaaggcgccccttttagagggcgccttttccgtgcgattaatcatcactgtttaaaattccgaaaaaccggagcaggttgataaacaggttgataaagtcgatataaagcgtcaatgccatcaaaggaatcaaatccgccgtgatgtcccggtgtttgatctggttcagatcgtataagatgtacattgaaaacacaatcgtgccgatgacggaatacgccatcatggcggcggaattcagcgggctgaaaatattaaagatccccaccgcgagaagcgcgataacagcgacaagcaagaaggaccataaaaacgacaagtcctttttcgtcttagcgccgatcgtgccgagcaccgcaaaaatcacaaatgaagagccgaatgcctccaatacgacataggcgcccgctgcggacgcataatggctgataatcggaaacagcgtcattcctgaaatgaaagcgaatgtaaagacaaacgcatatccgacggcttttttacggcgcagccaaaacgcggcgaagatcatgataacctctaagaccgacagcggaagcatcaatgccggcggaatgaactggccggtatacaggccgattgtcgcaactaacagcgtaaacacaaataccgttataatgcgctgcataatagattgtttgctctcataagcagcagtttgcatgtcaaaagtcctcccaaaaaatgatcgtgataggtctattataaataaaatgggagaaatttgcatgattttaagaagattttaaggatattcaagcctggcgttttgctgcgcactcctgcatatccatgaaatcatgcagttttttcgtcaatcccccgtgcccgaatcggatattccccttctgtcccggcgttttcgcaaaatcgagaaacgccagcacataaagacgcctgacgggaatgggaatgatgcccgcatcataaaaccagccgtcaattgtgttcagcactcctttgttaatgccgtattgcttcgtgcaccaatgcagaaagcgcacttcaggcaagtgcagataccggctctcccggaaagggacagttgaatgcttcatatgtaccgcctcctgtcatcggctgttttttaagattgctgtttagcttctttgctcttcagggaaaagcggtatttctccaccttatcaatttgtgttacttgggaattatgaaccgtaatctgaacagtcccgaaatcgatcgtttccagcgcactgataatcttttcaatcacatgcggatctacgcttcctttggacgtcatcatgctccccctttatgtctgcccgttcgtcttttgacaatggctttttaattcatactattctgataagaaatatacacttatactattatgttttctttcagaaatcaataacatttacacaatttttggatttgatttctccactcttttcctgcttaaaaaagaaaatcagttgactggcggccagctttcgtttgtgtacgatcagctatttgtgccggttcgatgtgctgcctaattaagtttttgaacatttaaatttcccgccataaaaaaaaagcgccccgcctctggccggagcacctttttctcacacttttgtttcctcaataatacatgtgacacccatgctggcgagcgcttgctccaggctgccgtatgtttgatactctgaaaaatcaagtcccaattggattgaagtctgtgccacatcaggccgaatgccggaaaatactgttctgatgccgaggagaaataacgttttcgacagcatgtacaattgctgcgccaccatcgtatcgacaatgggcacaccggacagatcaatcacaaggtttgtgatccgttttgcgacacagttttccggaactgtctccaaaatcacacgcgcccgttccgtatcaatcgcaccgatgagcggcaaggtgccgatcgtatccgcaatcaaaataaccggacagctcaattcggaaataagctcctgctgagatgacagcctcgaaatcattaatatctgatactgttcggtaaaatccgtcatcagctgatcaattgagccgttgacaaggtgattccagcggcgggcatcctcgcttgttacgatgtcctgatgctcatccataaaacgggtgaccgcttcccaaaagacggttcttgaattgccgatcgcctcaacgacctcatgaacctgagcgtcctgctccactctgcttttcgctacctgtgcggcccatttttctttgttctgctgaaaaacggccggatcttccagcaaagcgctggcgatggttgtgttcgtaaacgtatgctgctcgatcagcagttgtttcttttcttcacttaattgatcctcggaataaaaccgccctctcagcttccgtctcagcttgagccatttttccgtcagctcggccgaatgtgtaatgatataatcatgaagtaattggtctttgttcactgccgtctcctctttcaagatatgtacttttataaattataaatcggaaacgccgttcgtactagaggaattaaaaaaagccggcacattgaagcttttggttgcttttttcggttgcgggatacaatataaaaagaaatgaaacaggaggtcgtaaaatgattaaaaaaatcgcgacagtcgccgtatacactaatgatcagcaaaaagcgaaaacattttggacggaaaaagcggggtttgaaaccgtcgctgagcatccgatgggcccgaacgccttttggcttgaggtagcgcctaaaggagccggcactcatttggttatctatccgaaagcgatgatgaaaggagccgagcatatgaaggcttctatcgtatttgagtgcgaagatgtgtttgccgcatacgaacagatgaaaaagaacggcatcacctttttagatgaaccgaaacaaatggaatggggcaccttcgtgcaatttaaagatgaggatgggcatgtttttctcctcaaatcgtaatcaggtgtctcaattgactttgagaatcattttcatttaaaataaaacgtgaaaatgattggagagatgccagatgttcgtgcaaatcagaaaaatgaccgtaaaagaaggacatgccgacaaagtgatcgaacgattcagctcagaaggcgtgattgaaaagcaggaaggtttgatagacgtaacggttctggagaaaaaagtccgccgcggcgatgaagaagtcgtcgtgttaatccgctgggagtcagaagaccattggaagcaatgggaaaaaagcgaagaccacatcgcggcccacaaagcaaaccaaggcaagccgaaacccgattatatgcttgggacggatgtcggtatgtatcatgtcaaagccgttaaaacaggcgtgtacggaaaataataaagagcatttgccccagggcaaagctctttttattttttctcctcatatggaaggacgaacagcggtttatcatgcttccattccgcataaaatacatcctccgttcttttgatgttctgctttttcaggtcctgaatcagctgttcttctttcaccccggcttctttcagattttcatacagcacttcaccgtcaatgatcagtgtgaccggtaaagagacctgcttcggcttgatttgcatgtcgccgtttttcgtcgtgtcatacggaaatttcgggaggacgctgaccatcccgtttgtttctaaaatcgcgtattccgcttcctgtatggaaaagcaattcgcctgtctgagaaggctttgcagctgattaatatccagtttattctttttcagcacatcatatttcaattttcctttatggatgacaatattcggctcgccttccaacagctttctggagcttttcaccttctgcgtaatcagttcgatgaaataaattaaaattccccataacagagaagcaaaaatgatttcgacgatcctgacgcctttatcatacaccgcatttccgaccaattcgccaaggatgagcgcggaaataaaatcaaacggcgtaatctgtgagaattgagtttttcccagcaattttagaatcacaaataaaatacccaaaccgcatactaattcccaagccactgtaaataaatgtcccatatctgcaccttcttcttaaaagtcattaccattatggacattcgcctgttttctatacagcggctgacaaacacaaaaaaacgcagccgaggccgcgtttctctatttctgtttaatgtttttgattcgatctgacgaccctaacacacgcctcagcggcataaccggcggccgctccgaaaccggcaaacatcgcggccagacccagacccatcccttcccagccgccgacaccgatcatactgtaaacaaccgtaccaaatgcagcaaggccgatcaccgccaaaagacattcgggccacatttttttcggccatttcttacggagaaaagcagatatcccaaaattaagacaaaacgcggccagacagaacagataaaaataccacatgtcttttgcacctccatccgtgaggagctttttatttgctcatctctttttcaaacaaatgataacctgacgccaatccctttgattcatatcccatcccgctgtaaaacgactgaagcgccttgttttcggacacgcaatcgagccggattttcgtttttcccggacaagacacacccgtctccgcccatgccataatcgtccgtccgagcccggtgcctgcaaaccgcctgtcaatcgccagccggtgcaggtacatggactctccgtgaccctcatcgccccaaagacgtctgtcccactcgcttgcttcgggaagcagcatgacgacgccggccagctctgctttctgcctgaataaaaaaacatgtccttgggcgatcgcctcccgcatattgtgggtatcttccccctgtaaaaggccgctccactggcttgaccctttatcccgaagccattctgccgctgacacgagcagatccatgacctcttttgcatcatccttccgggcggggatgacccggaatgcccccgccgtctcctccgtgatcgtaaatggtgtcataaaagcctcctgtaatcagaatattcgacacctttattatagaccaagcgcaggacggaaaaaaacagccgtcatgtttgagggccgtttaaaaaatcttcttcttatcacgttcttcttttaaaatctcaaccgcttccctgaagcgcatggagtgaacgatttcacgctcacgcagaaaacggagtgaatcattcagatcagggtcatcggaaatatcaataatccattgatacgtcgctctcgccttttcttcagccgcaatatcttcatataaatcagcgatcggatcacccttcgcctgtatgtaagacgctgtgaacggaactccggccgcattgtgataaaacagcgcgctgtcatggttgacgtaatgatcgctgagccctgcatcacgcagctgctgcggggtcgcatcttttgtcagcttataaatcatcgtcgcaatcatttctaaatgcgcaaactcctccgtgccgatatccgtcaataggccgatcactttatcaggaatcgtgtagcgctggtttaaataccggagcgctgcggctaattcgccgtcagccccgccgtattgttcaatcaaaaacttagccagcatcgggttgcatgtgctcactttaaccggatattgcagctttttttcatatacccacatttacagatccctccttatacttgccatggccaaggaccgcggctccaatcccactgcgcgccgacctgactcacgccgaattgcagaagcggtccgtactcaggctcaaaccgctttctcagctgccttgagtaccgggaatattcatgaaactgctgaagcgcgaggcggtcgtgtggatgcgtatccagataaagcgtcagctccaccagcacaaagtccgccgcctggatttgctccagcagccgatagtattcatcatcaatctttttcgccatattcgattcccccccgataaggattatcatagaaatcgtaaagatccttccaaagggtcccttttttcaatgcctccatcggagaaaactgctccaagtgatacggctgaaaccgcatataaagatgcggcggcgttctgaagtattttctcccgatcggcgggcagggatcaaaccggctgtggaagggcttataagatttgaccggtgtaaacggctgattttctttcattacgatcctcctttcctaaacacatgaccttaataggtatgaatccgtatcagcttttatgctccgcaagaaataaaaaaagcccgttaaaaacggactcaaggtaacgctccggaatttgaagtgaaaaaatcacaatgaaaactctgattgaaaacgctgataatgtgtcaacgtatattccgtaatttgctgatcatattcaggatattcatatctcaataaaacagcgactgactttgaatatgctctaaagagaccctgacagtcaaacaatgccttccacacgctttcataagtattgccgacaaaagtattcagcaggatttcccaatcttccgcattcatgtatttttgaatatacttataattcttccctacacttaatgaaaactgattctctatcccgatcttccacgcaatcatacgcaaaacattaggccttagaatgtcattcatatgatccagcgcaaacagtatttctttacgcattaatcctttaatcacataggttgaaaccatccaaaattcattgcagcaatcatcaaactctctgggagtcggtttctttatatgatattgttcatcacttgcaataatcttgcgcttgatccggtcatccttgtctaataatatttccgccaaaccatcactctgtgtaaaataatgctctgtttgatttacagggatcaaagttaaatcgattttatgatgatctttaaaaagcattaagtaggagaaccagtctccgagttctggagggaaaagttccatatcttcaggtttttgcatcatcattctttcgccaaactgatccagccagctttcgtcagatgtgaaggagtccatatcggtcacaaaataagaaatatcatagtcttgaaatctgtctctcggtacatttttattggttcttgatccttccaaggtcacaagccggattcgctcgtccttcatcgcaatatcaagaatcaatttcatcatttcgttttcacttctcacatgtaaaatctcccgcataaagagagcctttagggatgctgtaaacggcagttaaaattcataaagaaaaagtttgtgagcttgcttataatttacagaaaagccctatgtactcgtgattttgctcaatcgtaacacagctgcaagaacatgagtagggcactcctgctgctcaagagtgcccttctcttatggtcagatatattggctgtcccgatgatgatgatggaacgggtagccgccgtagcctccgccatagccgccaaaaccgtaccccggatatcccccgaagcctccgtagccgccaaaaccgccgtaacccccgtaaccgccaaaaccgtaccccgggtagccgtagcctccgccgaaaccgtaccccggataacctccgaagcctccgtagccgccaaaaccgtaccccgggtagccgcctccgaagcctccatagcctccgccgtagcctccgccgtaaatcggtcttctttcattcatgatttatcgctccttcacataggttacagtccagcttatgacatcaggaacgaaacgtatgggcatccgcccatttttaacgaaataatcaaaaaacgctttacggaggaatccgatacagggcggccgcacaggcaaaataaaaagccggaacatgcacggtcccggccttttcgtctttattcgcctaaatctacattgtgataaacctgctgtacgtcttccaggtcttccagcacatcaatcagcttttcaaattgagctttcgcatcttccggaagctcgatttcattttgcgcaagcatcgtcagctccgcaactgtgaactcttcaacgccggcatttttgaatgcctcctgcacggcatggaattgatcaggctcggcatacacgataacactgtcatcctcttctaaaatatcgcgaacgtccacatcagcttccatcagcaattccagcgcttcatccgccgtcttgccttcaacaccgataacggcggtcgcatcaaacatgtaagcgacagacccgctcacacccatatttccgccgttttttccgaatgcggcgcgcacttcaggcgccgtgcggtttacattgttcgttaacgcatcaacaatgatcattgaaccgttcggcccgaaaccttcgtaacgcagctcgtcaaagttctcctccgcgccgcctttcgccttttcaatcgcacgctcaataatatttttcggcacactgtacgtcttcgcgcgctcaagcaccacttttaaagcctggttcgattccggatcaggctcgccctgttttgccgccacataaatctcacggccgaacttcgcgtaaatccggctcgtatttgcgtcctttgatgctttcttttctttaatattgttccacttacggcccattttgttccactctctttcacgaattgaatctgtatgataaatactctgtttctattatacctcagcggttgggttgtttcgagtgtaagactttagaaaaagcagggacgcttaaaatagccgcggcgcactaagccgaatctgagggttactgtacaaaacataaaaagcctcccttcatacaggaaggaagtcgcaagccaaaagattcattttattcttattacctatttcctacactgtatatcccgactcacgtggtaaaattttgatatcgaacaaaagaaaggatatggtcatgaaagttttcgaagcaaacagcctactggccgccgccaagcagcgtgcgagtgaatacaaagaactccgcggccaaatggtcaatctaaaaaaagccttccaaggcatggctgatctcggtgacggcgatttctctggccggggcgcaaataacattaaagcttttttcaaggaccacgccggcgtcacagacagctggcttgatctgatcgatatgaaaatcgcatttctcacaagccttcccggcaaagtcgaaaatgccgaactttccaattcgcatgtggaggaatcatttctggagcacgagcttacccacgccctcagaaaatcaaaggcgattatggaagagcagaaaaaagacatgcgctccatcctcggagagatcgaagacatcatttcgctcgaattgttttcaaccgagagcacagatcagaagctttcctcagctgacaaaaaaagaagcgaaaccatacataagctcggcaagctcgatcacgatctaacgaaagaatacgcagaaaccgaagcgaacgaacagttcatcaaagccgactttcagcagcttcaaaatgccacgggcaaaggaaaaagcgccacgccgcttcattacaacgccaaagcataccgagaaagcgacatccataagaaaaaaggcgagattgcaagacattcggatgcttatttgacgattaagaaggaagaagcgaaagagcggggagattgaaaaactgaaagaaagactgaaaaactatgattatgcgaatgccgatgaattctatgaaatggccaaaacgatcggctataaaaacctgacaaaaggacagcagcgctacttcactcaaattgaaaacacgcgtgaactcacagacggtttcaaaggcgttgccgtcggcctttatgattccggaaaagacgcggtcacaggcctgtgggatatggtcacagatccgggcggaaccgttaaagccattacaggagcggtggctcacccgatcaaaacgtatgaagccatttcagccgcaattgaagaatcgtaccaaaaagacatggtcaacggtgacacctactcaagagcaaggtgggtgtcatatgcggtgggcacagttgtgacatcagttgtcggcacaaaaggcgtcggcgccgtctcaaaaacaggcacagcagccaaagtgacgaccaaagtcaaagcagcagcaagcaaatcagcaacagctcaaaaagccataacggtctcaaaacaaaccgttgatcacatcaagcaaaaggtcaacacaggcattgaagtatcaaaaaagcgcgtcaaaaccaagttgaatcaaatcggagatctcactctagctgatattctcccgtatcatccgcgtcacgacttagtaccggcaggcgtcccttacaacgcagtcaacggggtcacacttaaagagggactgcaaaaattcgccaaggtcatcctcccgaaaccgtacggaacctccgcaagcggcagacggacaccggcaccgcatgtaccgccggtaacggtcaaatacggcgagcattttgcgaaatggaccagaaagaaagtattgaaaccgaatgtcatctacaaaacaaaagaaggctacacgtacaccactgacaactatggtagaattacaagtgtcaaagcagacttgcagctgggagaagcaaaacgcaaccaatatgcacagtcaaaagcaggtaaaccagaccgtctgacagatgacgacggaggccacctaatcgccactcaattcaaaggctcaggccaatttgacaacatcgtgccgatgaattctcagattaataggagcggcgggaaatggtataagttagaacaggcatggtcgcaagcgcttaaagaagagcctccaaaaaaggttacgatcacaattgaaaatgtgtatgagggtgattcgttaagacccactttatttgatataacatataaaattggagaagaaagaacaaagagcatcacaattagaaaccaaattggaggctgatgaaaatggaaacttcaaaaatggaacaactatatcaaaagattgctgaaaaaataaatgatatgattccctccgaatggatgagggttactttatatgccgaaattttggacgactccagagaagtttattttttctttaacacacaagaagacgaagaatatatttattcacacgatattccagaacattttcaagtaagtaatcgaatttacaaaaatatgctactagaccttcaagatttatttgatgaattaagggatgaatttaaaaagcaatcttcagatatttggactaacctcacactaaatttagatagaaacggtgaattctcaatcgattatgattatgaagatgtactcgcttcaaaatatactgatactgagcgacaagtaatttgggaatataagcacttgggaattacgccaataagcgagagcagcagaaagttccttgaacaatatctaaatgaacaatgaaaaaattggtgaactatatcaaaagattgctgaacatctaaatgaaatgattccatctcaatgggaaaagatcattttatatgctgaaatacttgaggactcagcggatatatacttttattttacaacaccaaataacagtgattatttattttctcattatatacctgaacactttgatgtgagtgaagagatttacgatcaactgctaattgaacttcaagagctatttgaagaactaaaagaagaatttaaactaggcaaccaagatatttggactaatctcactttaaaattagaaaacaccggaaagttttcaattgattataattatgatgatgttttatcctctgaacttgatgaccttcaaagacgagatgtttggaaatatcaaaatttagggatattgcctaaagatgagaacgataaagaatttgtaataaactacttcggtctataaatcaaaaaaatggctcagcccttctctgctgggctatttttgataactaggatttctcgatggctggaggtgaaagattggagactaaaaaaacgcaagatttgtaccagcttattagtcagaaattaaatgacatcataccttgtgaatggacaaaaatttacctttatgcagaagtattaaatgactctaccatggttcttttttacttcagaacaccagaaaataatcaaattatttattcacaagatatacttagccattacagcgtaagtaaaaatgtcttcaaaactttattaagggaaatccgtgaaatttttgaggaattaagagttgagcacaaaaataatattgatcaggtctggactaacttacattaacattggagagcaatggtcaattctaacttgattataatgatgacgatattttggcatttgagttagatggggatcaaagaattgcattaagggaataaaaacccttggaattttgcctgtagacgaggaagaagaggatttttaattacttatctaaatcaataataaagactggaggcatcatgaaactgcaaaaatgggtgaattatatcaacagatagctgaaggcattaacgaaaaaatcattccttctggatggtaaaaggtctttctttatgcggaaattctcgacgattcatctgaggttttcttttattttaataccccccaaagtgaggattatatctattttcaaaacattccagaacattttcatgtcaatgaggggctgttatttgacttacataacgtattcaagttttctttcaaaacaggcagcaccccataaacggatgctgcctgttaaatccttatgtatagtctgaagaggtcatttattttgttttttaaatatgaaaatagatatgacggtaaatatgatagctgtaataacaatgatccataagcttgcagccgtactgataaaatggccgtttaacttgtagacgatcccgtaatgcttttcatattcctgtatttggtccgcagaagcatgtttaaatactttatcaaccgagtccgtcataaacgcttttctgaacagaacagcggtgtggctgatagggaaatacataataatcttctgtacaaacaccggtacgccgccgatcggtacatatactccgcataaaaaaccgatggctgttccgacgatcgtacttaacgttgaaaatgcattttgtgtgtgaataaacagcgttaaaaataaattaatggagcttgacaaagcaactgaaagaatgatgatacccaatacttcaagtatatcagctccgcttaaaagcttgctgcctgttgaaacgagaaaaatttcacagcctaaaaaggcgatgaaggaaaagatcaagccgataacaaatgaatgaatgacgtagctcaattgaatggtcgctctggataaaggagctgttaaaaagtcatacgttctcttgctttctttatctttcaccataattccgaaagcgcctaaagtcgttgttacagctgtaatggacagcaatcccgccaccatccattcgttcaccatggctttggaatcatctgtcgaaccaaccagcgccttaatggcgtccagctgtgtctgctgcaagaacacggcatataacagaatgacgataaatactgacagcagagaaagaagcaaaagcgttcgatcacggaagtagatttttatgtttctgctgattaaactggataaagacttcatttacgcaatgctcccctttactggcaaagtgcttccttgttcttcgataatatggataaacacatcatccatattccctttgatcacctcgaaagattcgacttttccttcaagacttttcaaaatgtcaaacgcatggagagtggactctacacgaagagaataaatagagtttttaaccgtaaaggccagttgtttactttcaaaccatgccgtcggatcaacgtcttgcttaaacaaaatatgcagactgtcaaacgcatattgatctttcagctgactcggtgtgccctctgcaatcagccgtccttctttgatgaccacaacgttatcagccacagcggcctcttccatgtaatgggtcgttaaaaagatcgtcatgtttgtttcttcctgcagccttttaatcgcattccagacaaataccctcgtttgcgggtcaagacctgtcgtaggctcatctaaaaataatatggtcggtttatggatgatggcgcgggcaatatccgctcttcttctttgtccgcctgacaaatcgctgtattttttctccttaatatcatccaattttaaatagtctgatacaaactgatagttttcctgaacttgtgctttgcttaaatgataatattgtccgcgattcatgatattttcaaatacggtcaatcgttcatccaaaatactctcttgaaagacaaccccaatctttttgcggatatgattgttctctttcccctcaccaagcgtaaaaccgtcaattaccacttttccggatgtctttttgatcagtgtacagagaatgtcaatagtggttgatttccccgcaccgttcgttcccagaaatgcaaacagctcaccgcgtttgacagaaaaggatatccctttaactgcttcaaatgatccgtattttttgcgcagatccgttactgtaataatgtcttgttcttctcccattctgttcacctcgaaaagtaagattttatgccgttgaccactaactttatatcgactttgccgctaggatttttctcatttttatccaactttattatctttttataaataattatcttgattatgaaggtatacgcacataaaaaggcttcttaaaagaagcctttttatcgttttacgttaatattatgctttaattccccaagtcattaaccatcgccactttgttgagaagctttgtaaggatctcctgcacaaatagatttttctttttctgcaaaaacggtagaaattttagtcgcattcgttaaaaagcctttaacagttatcgcaaaatcttgcctccctgctctttttaaaggtataagatcatagcgtgatgtttttcccaattccgttttaataaataattaaaaaaggtttcattggtgcttatatgtggctttttcttcagcaactaatgaagacttaaagaactcattctctttgtaattcatttgcatatgtttcagccttttaaaaaagtaattttctaattgtttgtctatacaataaataaaacagcctttttgtccccgggtcatcaaagttctgtatgtgttgcgaataatttcgtctgcaagcttctcagcttcttctgaattttgctttagcattttcttcaaaccacgtaaggaggtatctgttttcgcccgctttgaatgatcagtcaatactactccatccctgcacactagatcatttcctataattacacctacataatcaaattccaaaccttggcatgtgtgtatacaacctatttcattaatagaatcttcgtcaattgcccacgtgtctgagttatttaaattccaactcattccgaattgatattcaggaatctctatatcatgaaattctgttttagcttttccttccttcacccaatcccaacagtaaccagcaactattcgagctttattattaactttattcagatcttctatctgtttacgcaattcatttggatttctatatatacgaaaatcgtagttcattccaatataattagaattcgcagtttcccgaatttgaagaacatcatctaaccagcttatataaccatctgaaccattgcaacgaaactgtgaatccagtttcatatttgtaacctgagcatctaattcttttgagaatttaaggattgtatcagtactgccaatatcttttaacgttactctttgatgttcatctatgaaaaaaacagaaagtttggaagcatttattatttccttaatttgattttccccaaggttattaaataaaccggatttctcatttaatcgatgcgcctcatcaacaattaaaacgtcaaattcacctgatggagcattgacataactgcccgatcctttaaataaattatcaatgtgccctttccgaaagttttgttttaacttagtagcatatacatttctgggagctgcattttttgttacatattgtgcaacgagacttcggtttgttgcttctactaataaatttacagcaagaacagattttcctgtacctggcccgccttctacaactaaaacttgtttagtgtttgtacgtaatgcctcattcgccaaatgtaaggccgtctcatacacaactttttgattatcaatcatcataaactctcgattaccttgaagcatactgtttaacgaatcttgaagagactttgaaggccgtattcttcctttatctattgtatataggatttctttgctgtctccatacttaatatactttttaatgaaatcacgaagcttacctgaatcacctttgataaaaaccggagcttcttttatataatattcatatattgaatcagttaatggatcgtctgtaccctgattcaaatagttatgtaagtatgtacaaggatataggttgatatcttctttttgcgcattttcattgtaatcctttattaacgatgcgtatgaccaggcttgataagatggatgggttgtttcgcgaattcctttatttataaacgttttaacgatggcctctttactatcaattttctctaccttctcccattgtttaagttccacaatcacaacagatgaacgatcattcttatctgatccagatataagaaaatcaatacgctttgaagtattgggtattttgaactcaatagcaattcctgcgtccttaggaatttctctatcacttaataccctatacatatactgcatagagttatcccaagatctaacctctctctcattgattttgccaattttatcattgtagtttttacaaatatttgttaccaacttatcgtcaaacacatcacttaaaaactcttcttttgtagcttcatagactatcattgtttcaccttttcattaactttttacgttatctctataattcgccactcaaaataactaaattgagttatattgagaataccatttttcttcaaattaatctgttttaatatgctctttgtaattaataattaaaaaggatccttcacatactaatataaaaaaagcagcgttctcaaaaagagaacactgctttatttcaattcgagctttgccacacactccacatgattcgtatgcgggaacatatccaccggctgcacttcgagggtctgatatccgccatcctcaagcacccgcaggtctcttgcaagcgtgccaggattacatgacacgtacaccacccgcttcggtttcatctcgatgatcgtccgcaggagggcttcgtcgcagccttttcttggcgggtcgacgacaagggtgtcggccgtgatgccttcttcgtaccactttggaatcacggtttctgcttctccgactgcgaattccgcgtttgtgataccgttcagctcagcgttgcgtttcgcatcctcgatggcttccggcacgatttcgacgccgtatacttttttcgcctgcttcgccaagaaaagagaaatggttccgatgccgcagtaggcgtcgatgacggtttctttgccttgaagctctgcgtactcaagcgctttgtcgtagagcacttttgtctgttccgggttgacctgatagaacgatctggcggagatggcgaatttgacgtctccgatgaggtcgtagatgtattcttcgccccagatgacgcttgtttcgtttccgaagatcacgtttgttttgtttgggttgatgttttgcacgattgatttgacgtgcggaaattgcgccgtgatgtcttcgatgatcttcgctttgtgcggaaaatcgcttgttcttgtgatgaagacgatcatcatttcgcctgtgacgacgccgtatctcaccatgatatggcggagccagcctttgtggcgttcttcattgtaggctttgacgccataatttgcgcaaatgtctttgaccgcttggacggcttcgtcgtttttagattgctgaatcaggcaggcgctcatgtcgatgatgtcatggcttctttgctgataaaatccggcgacgagtccgccttctctttctcctaccggcacctgcgctttgtttctgtagttccacgggtcttccatgccgagtgtcgggtgcacgataacactggacagatccagcttgccgatccgttctaaaacgtctttgacttgtttctgtttaaacaagagctggccctcgtaggtcatgtgctgaagctggcagcctccgcattgcttgtagatcgggcacggggcatccgttctgtgcgggctttcttccttcagctcaatcaagcggccgaaagcgaagccttttttgacgcgtgtcactttgatttgcgctttttcctcgggcagggcgttcggcacgaagatcgggaagccctgaatctttgcgacccccgctccttcgtgcgtcaaatcctcaaatgtcacgtcatagtattcatttttttctaccgggggtttcattttcatctataatcacctctagttttaccaatagccttgtttcagcgtgctggcaaaccttcaaatctgtcaggccttcaaaggtttccgatcacgctgaaaagatgacaaaatcctaaaacgaatactgttttaggattttgtccgcgtattaatcatccagctgttcagctttctccttcggcatgacgacgtgaatatgtctgtacagattcacgaattcgcctggcagcatgccgccgtattcgccgtccaggttcagctgcatcttttctgatacattgactttcacacggttcgcttttgtgtaaataatgtgctgatcgttaatatgatcgcctctgagcgccatgctcgcgactctgataaactccgcgagattggcttttttcaaaataattaaatcaaacatgccgtcattcaggctggaatcaggggccagcttctcgaatccgccgaccgagttggtcagcgtcactaaaaacagcatgatttcgccttgaaacagcttgccgtcatattcaatctcgacttctgtcggacgaagtgaaggcagcatttccattccttttaaataataagcaagctggccgagcatcgttttcagtttgcttggcacatcatacgtcagctccgtcagacggcctccgccggcgatattgataaagtactgtccgttcacctggccgatgtcgatcgggcgggccacgccgttaatgacggtatcagcggcattcagtatattttctctcggaatgcccagcgctctggcgaagtcatttgtcgtgccgaccggaatgacgcccagcgtcggtcgtttgtctaacggcgcaaggccgttgacgacttcattaatcgttccgtctccgccggctgcgacaattaggtcaaactcccgcaaagcggcttcttttgcggcatgagtggcatctcccgcacatgtggtggcatgggtggaggtttcataaccggcttgttcaaatttttgcaggacctgggcaagatttttcttaaaaagctcacgtcctgaagtcggattgtatattatgcgtgcacgtttcattatctcatcatcctacttaagagtatccgatccattattaacactaacaacctttaattatactatgacttgagaaaatcgcaacaatatgtacaggaattggcagaagaaaaaaggccctggctccatttaaggagccaaggcccgctgtcttactcttcttccgttccaggttttttcttacggaatttcaccaatacttcatatacgatcggtacaatcagaagggtaagcagagttgaactgattaaaccgccgataacggtgacaccgagtcctttagatatgacctgacttccgccttcgaagcccaatgccaatggaagcagggcgccgattgtcgcgatcgccgtcatcagaatcggacgcaatctcgtagagccggcttcaaggagcgcttctctcgtcgataagccttccgcttctttatggatgacgcggtcaattaagacaatcgcgtttgtgacgacgattccgatcagcatcagcataccgatcatggcattcaggctgactgtctctccggatacatacagtccgactaatgcgccgatgaccgtaaacggaagcgagaacagaatcgcaaacggcgctaatgctccgccgaacgtgatcacaagaacgaggtatacgatggcgactgcggcaagcatcgctaagccgagtttcgtaaaggaatcagcaatatccgctgatacaccgccggtatcgatcgatacattgtccggcttatccagtttgtcaactttcttttgaacggctgatgacaccttcgtgatgttgtcagaagtgacggttgccgttacgtcagcgtacactttgccgtcgcgtctggaaatggtgtcagatgtcgtgccgtttttcactttcgccacatcgccgatttttacttcttggcctgcaggcgatgtgatggttttatcctctaattctttcacactcttatactggtctttttcagtcttgatattcacgtcaagctctttgccgtcttttttcaccgttgtcaaaggagactgtgacgtttgagacatcagggcctgggagatttgcgaagccgttaagccgagcttgctgagcttctcctggtcagcgacgaacgtgtactcatcatatgtgctggaaaggcctgagtttacgtccttcagatccttttgctttttcatgatgctttcgatttctttgaccgtgcctttaatatcagactctgaatctccgtacacatagtacgttaattcattgttgttgcctgacgaactgaaattttgcgttttccattcgccgcggctggatgtttttttgatttcttttaagacattgtctttttctttgtcaaaatcaggtgtgtcttcttcgtatttcacgtagaacaatgcgccgttcgagcttccgccgagcgggctttgcgagcctaatgaatactggacggtatcgacatgtttgcgtttaagcagcatgtcttccgctttttgcgcagctttttcagcttcgcttttcgtttcacccggttcaggtgtatatgtgagctgcatcgttttgtccgcttgtgccggcagatagctcgcgccgatcagcggtacgaggaacaaactgccgacaagcatcagaaccgcgatgatggatgtaatccatttatggcttaatgaccaattcagcacttttttatagaaatcggccaatctgcccggcttatgctctttcgctttaacaggcgcgcctgtgagcgattttttgaataaactgtgcgcaagcattggcaccagtgtgatggaaatcaacaatgatgcggcaagcgcgaaaacaattgttaatgcaaacggcataaacagttcgccgatctgtccgccgaccatggcaagcggcaggaatacggcaatggttacgatcgttgatgacatgatcggtttaaacatttctttcgtcgcttcacgcaccaactgttttccgcgtaaaggctcatctttcagcctcatgcggcggtaaatgttttcgataacgacaatggagtcatcgactacccgtccgatggcgaccgtcatcgcaccgagcgtcataatgtttaaagtgacatcaagctgattcagcacgagaagcgcaatcagcagtgacagcgggatggaaacgatagaaatcatcgttgatttaatatctcttaagaataagagaatgatcacgaccgcaaagatcgcgccgaaaatcgctttgcttaacatcgtatccactgactctgtaatcggcttggccatatcaagagtcgagctgtacttgaaccctttatggtcttttttgtattgattcagttcatctttaatcgcatcggccacttctaccgtgttggcgtcattggcttttacgatattaattccgatgctgtcctttccgttcgtgcgggaaatggattctgcttttttcacatctttaatgtcggcaatgtcagaaagcttaaccgtcggaacccctgctgatgcgctttgctgtgcctgctgcgcagcctgagcgtccgccgcagatgccgcacccgcgccgcctgcttgaccttgagctgcggaagaagatgtgaccggaattctcatatctttcagatctttaattgacgtaatatttccgttaacgacaactgatttttccttgttgccgaatgtgtataatccaagcggcgtattgacgtcagagccttggattactttcttgacggtatcttcatcaagtccgtactctttcatttttttatctttgaaagagaattccacctgctcttcctgctgtccggaaacttgcacggacgcaacgccctggatgccttcaagcttaggaacgagagtgttttccacgtttttggtcagatcttcaagcgagcttttatcacttgtcacactgagcgtcaaaatcgggaaagagttgatgctgtaacgggaaatgtcgggctttttcgcgtcgtcgggaaggctgacattatccagcgcttcagcgacttcggttttcgccttgtccatatccttgttgtaatcatattcaatcataaccgatgagacgttttcagaggatgtggacgatacgacgttcactccttctaaattctgcaccgcctgctcgatcggtttcgtcacgtcatccgcaacttgactcggagcagctccgggataagtcgtatttactgagaggtaaggcatgttgacgtccggtatggattcctgcttcatattcagaccggcatacagccctgctacagtaacgataatcgtcatcagccaaactgcgaatttgttcttcagtacaaagttaataatgtggttcatcatgtcctccgttattttttattgactgactggtcattctatataatactaaacggtataactcaacatcgtcaaccaataaggcagtaaatttttctaaatttttcaaggattaaggggaagcacgtcatgaacgaaaaaaaagagaaaatcattaaaacaggcatccatttatttgccaaaaaggggttttcttcaactacaattcaggaaatcgccggtgagtgcgggatctcaaaaggtgctttctaccttcatttcaaatcaaaagaagaccttttgctgtcagcatgtgagtattacatcggcatgtctatggaagaaataaagaaaatcaaaacagaacatcagcataaaccgcctaaggacgtattccaaaaacaaattgcttatcaattccgggaatttatggagcacaaggattttatcattctcttgctgagcgaaaaggtcattcccgaaaatcaaaaggtaaaacagtattttcatgaggtcaatattcaatttaacatgctgtaccgggatgctctgctctccgtttacggagatgccgtcacaccgtttctggcggatgcatccgttatggcgcaaggaattgtaagctcttatatccatttcttgatttttaatgaacatacggcatttcagacggaaaatgtggcggcctttctgattgccaggattgatgatctgattacgggactgataaaagacaatcccgacccgcttttatctgaggatatctttactcagcccgcggcggacagagaaaaactgctcgcggatattcaaatggcaaaagcgcagcaggggctgcctgaggacgttctcgtatcgcttgaagtcattgaagaggaatgccagaaggaagagccgcgaaaaccgattattaaaggaatgctgtccaatttggccggcagcggaaatgaacagattgaaacactgcgggcttccattgaaactcatttcagccttaccatataaaaaaagcagcgcccttacaggcggctgcttttttttatcgttttttgatttcttcaagtaagatcttgttgaccatcggcgggttggcctgtccttttgaggctttcataatctgcccgacaaggaagccgatcgcgcggtcttttccgtttttgaagtcttcaattgactgcggattgctgtcaagcgcatctgtgaccagcttcagaagcacgctttcgtcagaaatttgcacaaggcctttttctttgacgattttttcagcgtcgccgcctttttcaattaattctttgaagacttttttcgcgattttagatgaaatggtccctttttcaatcagcttaatcatgccggcaagaccttccggagtcagcgcgacatcctcaagctctttttgttcggcgttcaggtaagctgaaacttcacccatcagccagtttgacgcctgtttggcttctgcgcctttattgaccgtttcttcgaagaaatcagccatttctttcgtcagcgtcagcaccattgcgtcataagccggcaggccgagctcttcgatataccgcttgcggcgctcgtccggaagctcaggaatggttgctcttacgcgttctttccattcgtcatcaatgtagagctcgacaaggtcaggctctgggaaatagcgatagtcatctgaaccctctttgacacgcattaaaatggtttttttcgtcgcttcatcgtagcggcgcgtctcctgctgaatgactccgcctgacagaagcacctgctcttggcgtttctcttcatgctcaaggcctttttgcacgaacgcgaaggagttcaggtttttcagctctgtttttgtgccgaatttctcccggccgatcggacggagggaaatgttggcgtcacagcgcagtgaaccttcttccattttacagtcggaaacgcctgtgtattggataattgatttcagcttttcgaggtatgcgtaagcttcctccggtgtgcggatatccggctcagatacaatctcgacaagcggcgtgccttggcggttgaagtcaacgagggaatagccgtcgcccgtatgcgtcagttttcccgcatcttcttcaaggtgaagacgggtaatgccgatttttttcgtttttccgccgacttcgatttcgatccagccgttttcgccgatcggcttgtcaaattgagaaatttgatatgccttcgggttgtccgggtagaaatagtttttccggtcaaacttcgtatccgttgcgatttcacagttcaaagccattgcggctttcatcgcgaattcgaccgcttctttgtttaaaacgggcagcacgccgggatagccgaggtcgatgacgctcgtttgggtattcgcttccgcgccgaatggcgtcggtgagcttgagaaaattttagattttgtttttaattccacatggacttcaagtccgattaccgtttcaaagttcacttcatttcaccccttacagttcaggtttcgctttatgatgatctgttgcctgctcaaaagcatgagcgacacgatatacagtgctttcatcgaagtgttttccgatgatttgcagtccgagcggcaggccgtccgcaaatccgcacggcacgctgattcccggcacacccgcgaggttgacagggatcgttaaaatatcgttggcgtacattgtgagcgggtcgctcgttttttcgccgattttgaatgccggtgtcggtgttgtcggtccgacgatgacatcgtatttctcaaatacgtcttcaaaatctttcttaatgagcgtgcgcactttttgcgcttttttgtaatacgcgtcatagtagcctgagctgagcgcgaaggtgccgagcatgatgcggcgcttcacttcgttgccgaagccttcagagcgtgtctgtttataaagatcgatcaggttgtccgcattgtctgtgcggtatccatagcggatgccgtcaaagcgcgcaaggttcgcggacgcttcggaagaagacagcagataatatgtcgcaagcgcgtatttgctgtgcggcagagatacttcttcccatgtcgctccgagtccttcaagcacttttaaagcggctaaaacggattctttcgcttctttgccgacaccttctccgagatattctttcggtacggcgatttttaagcctttaatgtcgcccgttaatgaagaaagaaagtccggcacttcgacattggcgctcgtagagtccattttgtccgggcctgaaatcgcctgaagcaggaatgcgttatcttccacggttcttgtgattggtccgatctggtctaatgaagacgcaaaagcgaccaaaccgtaacgggacacgcggccgtatgtaggctttaatccgacgacgccgcagaaagaagcaggctggcggatggagccgcccgtatcagatccgagtgaaaacggcacttcgcccgcggcaaccgcagctgcggaaccgccgcttgatccgccgggaaccgtatcaagattccaagggtttttcgtcgctttatacgcggagttttcagtagaagaacccatcgcgaactcgtccatattcagcttaccgattgtgacagcttcagctgcttgaaggcgctccactaccgtcgcatcgtaaatcggatcgaagttttcgaggattttgcttgagcatgttgtgcgaagccctttggtcacgatgttgtctttgacgccgatcggcattccgaagagaagaccgtgttcagaccgtccgtcaaccgcttcgtcaagctctttcgcgtaagcgcgggctctttcttcatcaagctgcaaaaacgcctgcaccttatcatccacggatgcgatccgtttgtaagattcatcaacaagatcggaaatcttgatgtcttttttatgtatcatttgtttcagttctgtgattttgtgatcaaataatgacatactgtctccctcctttaatccagaatagatggcacacggacatagccgtctttatgatcgggagcatttttcatgacatcctcgaccggaaggcctttacccgcttcatcttctctcattacgttcttcattttcagcacgtgtgttgtcggttccacgttatccgtgtccacttcattaagctcctcggcaaacgagatgatgctgtcaagctgttctgtgaacatttcagcttcttcatccgtaatggcgagtctcgccaaatgagcgacatgctttacttcttctatagaaattcgtgacataagatccacctccgcataattctccgtttcgtcatataatactgatcatatcaaaaacgagccctctaaagcaacaaaacgccgccttctgaggcatgatgaaaccttctctattttatcctaaatcggggagaaagagaaacgaattatatgtcagaaaatttttacttttataatttattggtagcgttttcatctttaagctgttctatgttggcggggattttttccttgaatggggcgggtttcgagagttgattgatcggggatactttgttaggtttagtaaccatagcctgcacaaaatcatgcgagccgcatgtaatgatgactaaaggctcaccgccggcgcaaaattccggcactactaatctacagaggtgatgcaacatttacttgaaagaagagagggtccaaaaacgtgagtattgaattaattatatctcttgggatttattttgctgccatgctgttaatcggctggtacgcattcaggaagacaacgaatatcaatgattacatgctgggcggaagaggactcggcccgttcgtaacggcgctgtccgcgggtgctgcggatatgagcgcatggatgctgatgggggttcccggcgcaatgttcgcaacgggcttatcaaccttatggctggcgctcggtttgacgatcggcgcgtattcaaattatctgctgcttgctccgaggcttcgcgcgtatacggaagttgcggatgatgcgattacgattcccgatttcttcgataaacggttccgccattcatcatcattgctgaaaattgtttccgccgtgattattatgatctttttcacactgtacacatcgtccggaatggtatccggaggcaggttatttgaatcggcattcggcgccgactacaaattcggtttatttttaacggccggtgttgttgtgctttacacgctgtttggcggtttccttgctgtcagcctgactgacttcgtacagggagcgatcatgtttgcggcattagtgcttgtgccgatcgttgcttttacccagctcgggagcgtttcgacgacgattgattcgatcaacgccgtaaacccgaaactattggatgtctttaaaggcgcgagcgtcattagcattatttcttatttggcatggggactcggttattacggccagcctcatatcatcgtacgatttatggcgattaaagaagtgaaggatttaaaacccgcccgcagaatcgggatgagctggatggctatttcagttgtcggttcattgcttaccgggattatcggggttgcttattctcatcacttcggagtctccgtaaaagatccggaaacgattttcattattttttctaaaatcttattccatccgctgattacgggcttcttgctgtccgcgattttagcggcgattatgagttccatctcgtcacagcttctcgtaacggcaagcgccattacggaagatttataccgcgcctttttcagacgggaagcgagcgataaagaattggtcatgaccggacgcttgtcggtattgatcgtggccgttatcgccattttgctttccatgaatccgaacagcaccattcttgacctggtcggctatgcgtgggcaggcttcggttcggctatcggcccggcactcttgctcagtctgtactggaaacgaatgaatgaatggggagcgcttgcggcgatgattaccggagccgcggccgttttgatctggattacgacagggcttgccgcttcaaccggcgtatacgaaatcattccggggttcttcctcagtctgattgccggtattgccgtcagcctgctgaccaaaaaaccggccgatgcttcttatcagctgttcagccggatggaagctcttttgaaaaacaagaaatagacaaaaagccgtcagatcttatccctgacggcttttttcttgcgcacttgtcctgctataaatactgtgagaaaatcatatcaatttactataagaaaaactgcggaggtgctgtgtaaattgagctggcctatcgaaccggacattttattaaagctgggcattgccacgctgatcggtatgatcatcggtcttgagcgtgagttgaaaaataaaccgttaggactgaaaacctgtatcgtcatcgccgtcagctcctgtatgctgacgatcgtcagcattaatgcggcatatcactttccgaaatattaccgtatcatgatggacccgctccgccttcccgcccaaatcatttccggcgtcggttttatcggtgcgggcgtgatcctgcgcaaaagcaatgacgtcatttccggtctgacgacatcggctatcatctggggcgcagccgggctgggtctggccacaggcgccggcttttataaggaggcattcgcaagcctcttgtttatcctgatcagcgtcgaatttcttccgtggctgatcagaaaagtcggtcccaatcgcttgaaggagaaagatatccgcgtgaggatgtctctttccgacaaagataaaatgaccgagattctaaaggaaatgaaaagcaaacagctccgcattcactcggtccggattgacgatctgcgtgaaacagaaaatccgattatggaagtgaaaatcagtgtccataaaaaccgctacaccactgacgtgtattatgatattaaagaaatccagggtgtcgtcggagtgaagtgtgatacgttataaaaaacgccggactggattcagccggcgtttttctttttatacgagggaggtaaagttatattcagtaatcggtgttttgttttcgatatcacgcctgaaacctttcagcatctcaagctcttcatccccgagtgagtcaagatcaaacgcctgatgcaataatccgtagatcagcatatggcgcaggcggaggaaatccggaattttttcaagccatgcaggatcaagatcattttcttccttgtaccctttcataaaatgagtcataaactcctctgtaaatgcaaccttgtcttcatacgggatgaccggataccacaaaatattgtacagcaaaatactgatatcattcacaaaccaattgtagccgctgtcatcaaaatcaaatgcagtgatttttccgttgtcccagttgaaattgccatggtgcaaatcggcgtgcacaaggccgtagttttccgggttcttcggcaattgccgcagttcttccattaaagcatccgcccgttcgaatacaagatgctgatcttcgggcacatattttcttagcttcagctgctcctcttcatcccattcttgccttttatatttcgggtcgctcagactgtagcttttcgtcagccgatgcatgttccccgtatacttgccaagctcataaaacagagacccgttccaatctgattcctccactttgcgtccgggcgctttttcatagactctgaacaaaaacgctccgcctttttcgtccggcacttcttcgacatctctgccatttaatgaaggaatcggttttgctgccgaaagcccgccctttgtcagatgatgaagccattccatttccccgaaaatatattccggtgttctgcggatcgtatgcgtaatttttaagatataagcttgattatcttttacaatttcgtatacgtagttctctgcgtccgcaataaattgaaacttagtaaatccgtatatttcaccggctttggccagcaccttatcttcctcaaaaatcgcttgaatatctttatgcatgctgattcaccctcttcttaacttttgtcggtgacgtgagtactcagcaaatgtcattcatcaacattcctgcccttcttttgttcatagcagattagtaaaatccgcctataaacgaatgtattttcctgttaatccctaattatacaaatatcataacatacctcatctctctcaccaacgatatacacaataaaaaacccttgctcatatagacatgaacaagggcatcttggttaatcgtaaatatggacggtcggttctttgtcacccgcattgcggacgataagcgcttcctggccgtctgatgaggtgatgttgatttcgacatcgactgagccttttgaataataatccatcagctcacccgttaagtattgggtaaaagcgatgacttcgctttttccgtaaaattgcatcgggatttcaattttcatttttctcatttcatcattttcatacatcgccgttccgactactccggtgtagttcgggaagtagctgtcgatcgcgtttttgaagcgtttaaacacttcggaatcgtcagggtatttctttgctgtgtcagtatcagccggatagaacacgtacttttctttgacatcatcccagtttgaaatggtggatgagccggctttgacttctgttttcgcaatgtaattccccggtacgattgatgtcttcggcgcttgtttataaagggcgacggtaatcggcacatttttcaggttatccattttccggagacggttaacgacttcctgggcgatttcttcaccatgactgcggatcgttttgtcgctgagctccacttcctgctgcggatcccctgtattttcgcgataatagtatacagagttgagagcgagaccgatcatgataccgccaagctggatgctgtttttatcttttcttactaagtaatcctgctcaagcatagacgctaagtaaatcgggctgttttcgtttttctcttttgccgatcccgagtttggcagcaccggatttaagccgagattctggaagttggcgtctgcttttttcgcctttttcagatcactgccttcttttttgcggtcaagccagctgagtaccgtatcctcatctaaatactggccttcctgatacaaatagtcatccgtcgggaacgtgtcttgggcgagccgcatcagtcccgtctcgaattcatcgatgtccagcctcgtattcagccggtccgcggtcagcccgcgcgcttttccggccttaaacggaagcaccatcttatagtaggaatcagagatattatatttcggtatgatcgctttttcagaagactttgccgttttctgcgtgatctcttcctctttgtttcccccgaaactcggcgaacaggctgacagcatcaatactgccgccgttgccgtcgccgccaatgccaacatctttttcaatagaaaacactcctcttatttctttagctctcccaatagctgtgcttcatcccatacttcaatgtttaattcctgcgcttttgtcagcttgcttccggccgcttctccggcaatcagcaagtctgtttttttgctgacagatcccgtcagctttccgccgagcgcttcaatctgcgttttggcttcatttctggacagctcttcaagctttccggttaacacgatggttttgccggcaaaataagagtcgctgtcctccgcttttacttttttcgggcctttatagagtgtgttcacaccgagctcttccagttcattcaaaagctcaagcatttcttcttttcggaaataggtgatgacggcatcggccatcttttcaccgatttcatctactgccagcagctcttcttccgtggcttgtttcagattttccaggctttcaaaatgcatggcgagtgttttggccgcttttgagccgataaaacggatgccgagaccgaacagcaggcgttccaatgaattctctttcgatttttggatggagctgatcagattgtcagttgatttttctcccatccgctcaagccggatgacctgttcttttgtcagcttatataaatcagcgacattacggacgagatgttcacggaaaagctgtgtgatgacacgttctccgagtccgtcaatattcatcgcgttgcgtgaaacaaagtggatcaggccttctctgatttgcgccggacattccgggttgatgcagcgcagcgcgacttctccttcaatgcgcacaagctcgctttcgcactcagggcagacggtcggcatattgaattctttttcttctccggtccgctgttcaattaagacattgacgacctcagggataatgtcgcccgcttttttaacgaccactttatcgagaatgcggatatccttctctttaattaaatcttcgttatgaagcgatgctcttgagaccgtcgttcccgcgacttttaccggttccagaacggcggtcggcgtaatgacgcctgttcttccgacattcagttcgatatcgagaagttttgtcacgacctcttctgccgggaatttatatgcaatcgcccagcgcgggctttttgccgtatacccgagctcttcctgctggtcgagcgaatcgactttgatgacgattccgtcaatttcatacgggaggtcggcccgcttcgcctgcagctcctcgatcatttcaattacttcatctatcgtggcgcattgtttccgttcctggtttgttttaaaaccgagctcatccagaaaatccaggccctgactctgtgtttccacacccatttcgtcaagctccgctatactgtagacgaagatgtcaagatttcgtttcgctgcaattttcggatcgagctgtctgagtgagcccgcagcagcattccggggattggcgaacggctcctcttcatgtttcagccgttcttcattgagcgcttcaaatgactgtttcggcatgaacgcctctccgcgcacttctatggaaaggtttcgtttcattttcagcggaatgttgcggatcgtttttaagttttccgtaatatcttcgcccgttgttccgtctcctcttgtcgcgcctctgacgaaatagccgtcttcataacggagagaaacagcaagaccgtctattttcagctccacattgtaagcgacgccgtccccgacagcctgacggacgcggcggtcaaaatcgcgaagatcatcatcgttaaatgcgttgccgagactgagcatcggcgtgccgtgctgcaccttttgaaatgattcaagcaccgctcccccgacccgctgtgtgggcgagtcaggcgttctgagctccgggtgctcttcttctatcgcaatcagctcctgcatcagtctgtcgtactcggaatccggtacgctcggttcatctaaggtgtaatattcgtaactgtactgatcgatggtgcggcgcaattcatctgcccggtgtttcgctgtttctttgtccatcatgttcttcctttcctcttcaggttactgcttttcaatcggcgcaaaggcggccagcagccgcttcacgccgactgggctcgggaatgcgatatcaagctccgtgctttcgccttctccttttacgctgacaaccgttccggtgccccattttttatggcccgctttatcgccgacagcccagctgagcgagtcgccgcctgttttattcgcgtaggaaacaggacgggatacgggcccgcgtttcggctgcatttttctccccggctgcatgcgcgggtttttcttctcatttaggttctccaataaatcgccaggtatttccctgataaagcgggattccggattcatattggtgcgtccgaatagggtgcgcattttggcattcgttaaatacagttcttcttccgcccttgtaatgcctacatatgcgagtctgcgctcttcttccatctcagcttcttccatcagggagcggctgtgcgggaacacgccttcttccatgcccattaagaacacgacaggaaattcaagccctttagcggcgtgcagagtcattaacgtgacggcatcctttccgcccgattcctcttccttctggtcgagctggtcaatatccgcaatcagcgccaagtcggtcagaaacgcgacgagagacttgtcttcgcttttttgttcgaagtttttcgtcacagaaagaaactcgtcgatattctcaagacggctttgggcttcaattgatttttcagccttcagcatttctctgtattccgttttatcgagaatttcttccatgagttccgtaatggacaggtaatcctgcatattcgtcagattttcaatcattgcgccaaagccgtcaagcgcgtttgccgctttggcactgacgccgatgaaatcaacctgtttgatcgcctggaacagtgacatcccgttcatcgccgcgtatgaagcgattttttcaagcgaagtggcgccgacaccccgcttcggcacattgacgatccttgtaaaactgatatcgtcgtccgggtttgacacaaggcgcagatacgcgagaatgtctttaatttctttcctgtcgtagaactttgttccgccgacgatattgtagttcagtccggcttttaaaagggtttcctcaataacacgggactgggcgtttgtccggtataaaatcgcgatatcggaaagcttccgccggcccgagctgttcagctcataaattttgcccgcgacgaattggccttcgccgaattcattgtcgccgctgtaataagaaagcttgactccttcgtcattccccgtccacaagtttttcggcttgcggtttgagttgtttttaatcacttcgttggccgcttgcagaatccgctttgtggagcggtagttttgttcgagcagaatgacgtttgcgctcgggtaatctttttcaaaagaaaggatattcgcgatatccgcgccgcgccatctgtaaatggactggtcggagtcaccgacgacgcagatattttcaagacgggcagcaagctgcttaacaagcaggtattgcgctctgttcgtatcctggtactcgtctacgtgaatgtactggaatttgcgctggtaaaactcaagcacttccggcacacgctcgaaaagcttaatcgtcgtcatgattaaatcatcaaaatcgagcgattggtttttcagcagttttttctggtaatcggcatacacgtcactcgtgacctggtcatagtagccgccggccgtttttgcgaattcctccggttcgatcagctcgttttttgcgctgctgatggagcctaaaatacttctcggatcaaactttttcggatcgatattccgctctttcaaaatccctttaataacggagagctgatcagccgtatcaagaatggagaagttacggttgatgccgatcctgtcaatatccctgcgcagtatccgcacgcacatgctgtggaaggtggatatccagatttcatccgcgccgggcccgagaatgctctcgacccgctccttcatttctctggcggctttatttgtaaatgtaatcgccagaatattccatggcgcgacgtgtttttccgccattaagtatgcgattctgtgcgtcagcacacgtgtctttccgcttcccgctcccgccatcagaagcagcggaccgtccgtcgtcttaaccgcttcctgctgaacgggatttaatccgcttaataattgattgctaatataattcatatccgttcaccgcctatcaaacatatgttctatcataaatcaaattcgtctgcttggctacttcgtctttacagccgccaccgttttgagcgcctgatcaaaatcttcatatacggcatttcctacaacaatgacatcggcatggcggccgaaccgttccgccgtttccgcatctttaatgccgcctccgtaaaacaggacggacttgtccagcacagctttcgttttctccaccgtttctatgtccgccagcattccgctgtattccaaataaaaaatcggaagatgaagcaaatgctccgcgacccgcgcataagcgagaatatcttctgtttctatatgtgtatccgcctccgtcaaagcggccgctttacaatcagggttgacgatgcaatagccctccgtcacgatttcctccatggacatcagctcgccgtattctttcatcgcctgatggtgcatgccgacaatccagtccgcatttttgctgttgagcacactcggaatgaaataaagatcaaatccgggcacaatggaatcaatcgtcgatacctcaagtacgcacggcactaaaaaacgccgcacctttgacatcagtctcagcacattgtcctcggtgatattgtcgcttcctccgatcacaatggcgtcagtccctgattcacaaagccgttccagctgttcatccggtaaatctttattcggatcgagtttaaaaacgtgcttccactcgttaacatcgtacatgcgttttcgttcctccattcgtttcttgccatttaaacattataacaaattcatttggcccggaaaaacggaaaaagacgtcattcatctgattcataaaaaaagatggcgctccggcggacgggaaacggccatgtttgaaaacagacaaaatgtggaatgtcaaagagaaaaaaggcaaggagtctgatttcaatggaacaagccattatcgtactgatatgtatattgatttttattattttagttcccgccgtattgctgctttggatatacataagagacgaaaaacaggaagaacattcagtgctgcgcaattatcccgtagcgggaaagctgcgctatatatttgaaaaaatcggaccagaactgcggcagtatttattcagcaatgataacgaagaacagccgttttcccggagagaatatgaacagacggtcatgtcgggaaagtataaaagcagaatgatgggcttcgggtcagaacgggatttcgatcagccgggctattatatccggaatgccctctttccgaaacaaagggaggagctgcgcacagatcaaacgccgaagatcgacacgatggtatacaagattgacaaggacaacctgctgaaacgcagcgaacaccgcgaaaaaacaaaagcggatccttattacctgcatccggacgatgtacaagtgatcggccgtgacacatgcaagaaaccgttttatgtgaaaggattaatcggacaatcagcgatgagctacggctcacttggcgaccgggcaattaccgccctgtcaaaagggctgcaccaggccggaggcacgtggatgaatacaggcgaaggcggcctgtctgagtatcacctgaaaggcggtgcggatattatctgccaaatcggactcggactgttcggcgtccgtaccgaagaaggagaattttcgtgggaagaatttaagaaaaaaagccgtctcgaacaaattaaagcctttgaattaaagcttgcgcaaggagcgaaagcaagaggcgggcatattgacggttcaaaggttaccgaagaaattgccgccatcagaaatgtgcagcccggacaatccatagacagcccaaacaggttcaatgaattctcaaatgttccggacatgcttgattttattgaggaattaaggactgtcggtgaaaaaccggtcggcatcaaaattgtcccgggcagccgaaaagaccttgaagatcttatttcccgtatgagttcatcaggcaagcttcccgactttattaccattgacggcagtgaagggggaacgggtgcttcctttcatgagctggcggattccgtcggtctgccgattatgaccggcctcccccttgttgacggccttttgaaaacatacggtataagagataagctgaaaattttcgcatccggaaagctgctcactccggataaaatcgccgtcgccctcgcgttaggcgcggattttgtcaatattgcccggggaatgatgttttcagtcggctgtatccgcgctcaagtatgccacaccaatcattgtcctgtcggagtggcaacaaccgatccgaagcttcagcgcgcgctcagtatcgaagacaaacagcaccgcgtctgcaactacgtgctctccttgcgtgaaggactgtttcaccttgccgcggcggcgggcatcagctcgccgattcacttctcagctgaacacatcgtataccgagaggaagacggcagcctgagggaacttcccggccttatgaatatgaatcagcacgcataaaaaaaaccgcctgccgtcatcggcagagcggttttttacgttgctgaggaggattctcctttgtttacacggtcaagcgccatttcataggcgtcgttgccataatttaagcagcgtttcacccgggaaatcgtcgctgttgaagcacccgtttcgctttctattttgtgatacgtgtttccttcgcggagcattcttgccacttccaaacgctgcgccagcgattggatttcattaatcgtacaaagatcatcaaagaaacgatagcattcctccagatctttcagcgataaaatagataagaataactggtccagttcttttccgcgtaatttatcgatttgcatcgtcaaacaccttctcctttactaatggaagctgcatcgagatcaggcacgatattaatccatgtctttcctggcacaaacggaagaatctcaccgccttttacgggcagaatacgtccgtctttatattcccagtctgactcaataacatcgccgtgctgaagcaggaggccctttccccctgattgaatatcgatggcccgccttccatctttgtctgtaatgcgatggccggcttcaacaataaaaatgttgtgcatggctaaaggctttccggtctcccggtctgtcgctttcacaccatcagagcttcttgtataagcatcagcttttttatcataatcgtattcgacaagatttgtaacgttttgtgttccataatctatccgaatattgtaggtttcgtttccgggttttgcgtctgatgtctgaaatggaagcggttttgttttttcgttcagcttgtatcccttttgttccgccgcctttctgatattgtcataagacgtgtaggaattgtggggaggcttgctgaaatcggctctccaaaacaggcttccgtcaaaatccaaaccgtttatataatcgtaagctccggactccagctgctttttagcgccgggactccagccatgatggacaaatatgctgttaaatccgctgctgagggtgacaaaatattccctcgcgctccgcacaggtccgaccgtttccggcatctcactctgaaaaatcgcgagaaaccgcgtaatccggccctctgccagcgcttcgatgacaacatccgcctttgacagcccggattggggcctcgccttcggatgattgttcactgcgactgcaatcggacggcgttctgcaagcttccgctcagttttcaaccctgttaaaggggcttccgcctctttcggctgcacctgatcggcatcattctgccggcaggcggcaagcagcaaaaacgcaaaacaaagcatacaaacggttttccatcttttcatatgtcggctccctgcttttatattttaacgcattatcgatggaaagagtacagtttttttcatcacgtcgaatattcctctcggcgtaatgcgaatataaggcaggtgtgtgctctgcaaaaagagcagcgtatagatcggatcgcagaatcggtagccccgctcctccagcagaatcctcagtttttgttctttctcaagcacctcttcataattctccgcagatgcggaaccatttaaggcgaggggaatttcatgaagaattttcccgttttcggcaagcacgattcccccgccgatttctttcatccgtgagaaggcgagcaggatatcttccttattttttccgacagcgataatatctccggttgtagtgtaggaactgacaaagccctgcacccgctcggcaaaacctttcagcattgtattgacccgccattttccatgcttatcgagaagcgtgagatagctttcatcatgatcaaaagaaagctggtcaacagaattatcaatcgcaatcatatacggctccataatgaccgcgttgcgcattttcacacccatcggcattgaaaactgtaaatcatccatcttcatatcatatgaaagctcaagagggacaagaccgccctttttccaatccgtttctgtaaacgccttcatatttcggccgtcttctctcagcaggatgcctttggatatcaccgtaaccgggtccggattcatagggtcatcaagaatgttcaatgaggcaagccgtcccgggccgactacaccgagaaagtcgtccatctgataatacttcgcgatattaaaggacgccatattgtaagcgtcaatcgccggaactccttcctccagagcgattttgattaattcattcgtcatgccgcctttataaaaaagcggcgacgccccatccgtcgtgtaaaagaaatgatcataatgccggaagcctttttgatggaggtcctgcagaatcgtcctcaaatcagggcggatggatgaatgcctgagcgacacatagtagcccaattcaagccgtctcatcacctcatcgccattcatcgcctcatgatcggaatcagcgccgaacagtttcatcttcgtaagtgttttctcagaagcgccggggaaatgcccttcgatccgcttgcgcagtttctttgtcgcctgcatgcaatgaagcatcaagtcatccccgtccatgagccgcggccagccggtcaattctccgccttgaatgacatccgggtgctcaatccattgcttgcggacatcaaaagaaagaagctggtcctcattcagcacttcagtctgcagatcatatctggaccaccagaaatattgcaccggctgttttttcagttcttctaatatggtaagcgctttcttttttccgctgtgcaaaaggaaaaacaagttatcattaacaaacgtcgttgttccgaattgagacacatattcggcgagcgtttggggattatatatttgaaaaggatgtgtatgcggttcaatgtaacctggcacaatgtattttccttcacaatttatggtatgaatgtgctctgctgcatcaggaagctcatcaccgacatatacaattcggtctccgtaaatccagatattctttttcagccattgttttaaaaaaggatttaaaacgagagcgttccgtaaaagtagcgttggaagcagctttgagtctacaacatccgcctgtgatctgatgtctttatttttccagttaaaggtacgttcggacattcacatactctccttcgcttatattagactcatcgtatcacatccgcacaattatcgcacggttaaaacgttacaaattattgaagatgaacgaaaagtaaaggagctgaaataatgaaaccgaatatcagtttattaaacgccgttatgcgaatcacttgcggccttaccattttgtctgctgcgtcagcaaaatacacgagaaaaccgtggtgcaaaatgcatcttttctgtatgatgatgggcgcaatgaaagcggcgtccggcatcctccgcttctgtccggtaacatatatgttccaggctggaatgaatcaggatgacagccgccagtaagaaaaataacaagccgtttcggcttgttatttattttctcctgttataaaagagtccggcgagtccgagaaggatcggataacagaaagcccagccgctgaagctgtatatgccgatacaaagtccgagtgacgccagcgcggaccaccagccgataccgaagcggcgcagcagcttgagcccggccgccatcgtaatgacgtatgaagcgataaatgcggcactcgggcccttcagcagcacttcaggattgagctgaaacacccattgaatcaaaagcaccgtaaaaaatatggcgccgagcgtcgtcagcacacgcacaggggtgcggtttttttgatgcagccggtcaaagtatttcggaatatgcccttcccgcgacatcgcatacaccattcttgaaaagcccgcaatattggcatgaacggtgctgaatgtaataaacagcgccagacatgcggttatgtatactcccgtccgccccgttccgtttgccatcagcaaattgagagacgcgatgcctttttcgtctccgtaagcatgggttccgaccgtaacataagcagtcagcgtatataacagtcccacacacgcggcagccgcaaacaggctgatcggaatatcccttttcggatgtttaaactcttcggcaagcggcgtaatcatttcccagccgacaaaggagaaaaagatcataactgcggccgagcctgcggcatgccatccgtgcgggagaaacggatgaaaagagccggacgtgacatgcggcagtgaaacggcaacagccgcggctaacaacaatataatcaaacaaatgatcagcgtgccgatccctgcggatagctgaagccctcttaaatgaagaaacagagataaagcaagcatcgctgccgcaatcaatgtaacggcacccgcacccgctccggtgacgcttgtgatgtactgagcaccggtcagcgcgataatcgggacgccgatcggaactgatccaagcatgatccagcctgaaaccgctccggcctttttctgaaaagcaagttccgcatatgctgtaatccctcctgcactcggcactttctgcaccaaggcggagagtgtccccacaatcggaaaagccgccaatgacattaaaagccaagcagcgagcgaagcaggccccgctgtatttgccgcaacagaaggcagaattaaaatcccgcaccccaaaacagcccctatcgtcaatgcggttccctgcacccatgtgagagagcggcgcagcgtattcatggtgattccccctttttgaaaagctggctttattataaagaaagaaaacggtcttccatatgctacaattaagcaaaaacggtttctttcatttaaaaataaaggaattacaggaagatcacttaaaatgaaaaggggcagccttatggaccaaacagacttacatattttatcgcatttgcagaaaaacgcccggctgacaatggtggagctcggcaagcttgtcgggctcagctctccaagcgccgctgaacgggtcaaaaaacttgaagaaaaaggcgtgatcacgggctacggcgccaatatcaattttgagaaactgaataagcacgttacggcttttatcctgatggaaccgagaaactgcaagcattatgccgcatttgccggcaagcatccggatgttatagagaaccacagaatcaccggcatgtacagctacatcacaaaagtcgtgacagaatccgtccatacgctggaagactttatcgatgaatgcatgtcacacggcaagccgacaaccttggtcgtcctgtcttcctcagcctttgaaggcgcccttacgtaaaaagaaaccccccgcatcttcatgacgcgggggttttcctcattatcgcagcgatgctttcagcgcacggacgccgatatcgcttctgtaaaacagtccgggttttgtcagaccggaaacggcgctgtacactttatctctcgcctcttcaaatgtctcagcaaatgccgtgacattggcgacccggccgccgtttgtgacaaattgatcgccgtcttttttcgttccggcatgaaaaacggcgatcccgtcttcagcggatgtcaaactgccgatcggtgtccctttcgcatagccttcaggatagccctcagaagccagcacaacgctgacagcggccgtatccttccaccttaggtcaacatccttctcatgaagcagatccaaaagcacctgaatgaggtctgattccattctcggcaccacaacctgtgtttccggatcaccgaagcgcgcgttgaattcaatgacttttgatccgttttccgtcagaatcagccccgcgtacagcacgcctgtgaaggagcgtccctctttcaccatagcttttgccgccggcttcacaatcgtttcgacagcgcttttgacgatgtcatcggaaatgtgcggcaccggtgagtaggcgcccattccgcccgtattcggccctttgtctccgtcgaaggcgcgtttatggtcttgggcgatcaccatcggatagacggtctccccttttacaaacgccattaaggaaaattcttcaccggcgagaaattcttcaatgaccacggatgcgctcgcctcgccgaatttctcatcctcgagaaaatcatgaaggcattcaatcgcttcctcttccgtcatcgcgaccgtcacaccttttccggcggcaagcccgtccgctttaatgacaatcggcgcgcctttctgctgcacatatgctttcgcctcttcaaatgaagtaaacgtctcatactccgccgtcggtataccgtattttttcattaaatccttcgcaaactgtttgcttccttcaatgattgccgcttgttcggacggcccgaaaacaaggagtccggctttttcaaactcgtccgctatcccttcaatgagaggaacctcgggaccgataatcgtcaggccgacatgatgttctttcgcaaaggcaatgagtccggcatgatcgctttcttcgatgctgaccagcgtcgcgcagtctgccataccgtcatttccgggcgcggcgtacaccgtgtcagtaagcggactttgcgccgctttccaagccaatgtatgctctctgccgcctttaccgataatcaatacattcacgcttcgttcctcccttaatgtttgaaatgtctgatgcctgtgaagaccatggcgatgccgtattcatccgcttttttaattgaatcttcgtcgcggaccgatccgccgggctggatgatcgccgtgacgcccgcttttgcggcttcttcgactgtatccggcatcgggaaaaacgcgtctgatccgagcgcgctgccttttgctttttctccggcctgctcgatggcgattttggccgaaccgacgcgattcatctgtcctgcacccacaccgaccgtcatatggtcttttgcaagaacgatcgcgtttgatttcacgtgtttgacgactttccaagccagcttcagatcttcccactcctgctcgctcggctctctttttgtcggaatgctgatttttgcgtcatcaaatccgtgcacgtctaaatcttgaatcaaaaggccgccctgtacggaagtcagctgtttttctttcttccctgctgcattcacgtcaagcgtgagcagacgaaggtttttcttcgacgtcagcacattcagcgcttcttcactgaaagaaggggcgatgatgatttctaaaaagatgccgtgaagggcttcggccgttgcctgatcaacttcacggttgagcgcgatgatgccgccgaaaatggacgttttgtccgcttcatacgctttattgaacgcttcctcaattgtggctcccgtaccgactccgcatgggttcatatgtttaacggcaacagcggcgggttctgtaaattcccggacgatttgaacggccgcatccgcgtctttaatgttgttgtaagaaagctctttgccgtgaagctgttttgccgccgcaatggaaccggagacaggcagtgcgctttggtagaaaacagcctcttggtgagggttttcgccgtagcggagcgattgttttttctcaaatgtaacggtgaattgctcagggtctttctcaccggcctcgtgtgttaagtaatcagcaattaatgcgtcgtatgccgcggtgtggcggaatactttggccgcaagctcgcgttttcttttaagcgaaacgccgccgtattctttaatctcattgagcacggagctgtaatcggccgggtccgtgatgaccgtcacatcctgatggtttttcgatgcggcgcgcagcatgccgggaccgccgatatcaatgttttctatcgcttcatcgtatgttacgtcttcttttgaaatcgtttctttaaacgggtaaaggttgacgaccacaagatcaatgggtgcaatgccgtgttcattgatctgcgccatatgctcttcattgtctcttacggcaagcaggccgccgtgaatattaggatggagcgtttttaaccgtccgtccataatttcaggaaatccagtcacttccgaaatgccgatgacatccacaccgttttcctggagaagtttttttgttcctccggtcgaaatgacttcgacgccgagctctgtcagttcctttacgaaaggtacaagatttgttttatcagaaacactgattagtgcgcgtttgattgtcatgccttttcacctctgttatttagtcccagcagctgtttcacaacgctcggataccatttgtgctcaagctcgtgtattgtatgttccatatcttcaagcgtatcgttttcctgtatctcgaatgctttttgcgcgataatcggtccggtgtccatgccttcgtcgacgtaatgaacggtaatgcccgccactttcacaccggcacgatgcgcttgtccgacagcgtcaatgcccggaaacgccgggagaagcgacggatgtatattgataatcctgcctccgtatgcttcaagcagcgtatctccgatcagtctcatatagccggcgagaacgattaattcaaccccgtgaaggcgaagctgctcaataatggcccgttcaaaggcggccttgttttcaaaagctgacggttcaaaggcgaatgacgggatttgtaaagcctcggccctttccaccgccttcgcctgaggcttgtccgtcacgagaagcgatagctccgcgtcccacttctcttctctcatgcgtttggcaatggcctcgaagttcgatccgtttcctgaagcaaatactgcaaattttttcatgaaagagccgcaccgccgaaagaaatgccttcgccctgcttgacccgcccgatcaaataagccttctcgcccttagcttcaagcgtgtcgatgacgtctgtcaggttttcttctttaacggcaaggacaaaaccgatgcccatgttaaagacgttgaacatttcttcttctttcagcttgccgtgctcctgcaaaaacggaaaaatcggcgggatcggccatgacccgtgatcaatttccgcgctcaatccgtccggcagcatccgcggaatgttctcgatgaatcctccgcctgtcacatgcgccatgccgtccaccttaccgcttttcaccgcttcaagcaccggcttcacatatattctcgtcggttccagcaattcttctccgagcggccgcgcgaagggttcatagacagtatccaaatcaagtccgccgtcatcaagaagcacctttctcacaagggaaaatccgttgctgtgaaggccgcttgaagtaagtccgattaagagatgcccctcttcgatatgttcaccggtgacgatttcgtctttttccgcgactccgactgaaaagccggcaatatcgtattcatcagccgtatagagccccggcatttccgccgtctcaccgccgataagcgctgatcctgactgctcgcagccatctgccacgccctgaacgatctgctcaatttttaccggatcggccttgccgactgctaaataatcaaggaaaaacagcggctccgctccttgggcgagcacatcatttacacacatcgccaccgcatctacgccgatcgtgtcatgcttatccattgaaaaagcgagtttcagcttggtgccgacaccgtctgttccggaaattaaaacaggcttttgatacgggagctctgacagatcaaacattccgccaaaaccgcccaagcttcccataacgccgagccttttcgtgcgctccacatgttttttcattcgtttgacggcttcatatccggcttcaatgtcaactccggcatttttataagcatcagacatccctatcactccttgtcaattcgtttctcctcaaaaggcagaaagagaaaggcagcctgaaatcgcgctgcctttatatcattttcagactttattttgtcagcactgcttcttttacgtgaggaagcactgtatcctgataaatttccgtcggatatttgcccgtaaaacaagcgaggcattgtccgcaattggtgtcttcaaattttcggccgactccttttaacaatccgtctacacttaagaaagaaagcgtgtcggcgccgataatctggcggatttcttccactgaatgcgaggaagcgatcagctcctcatgggttgatgtgtcgatgccgtagaagcaaggatgggcgatcggaggcgaactgatctttacatgcacctctgtcgctcccgcttctcggagcattgtgacgatccggcggcttgtcgtcccgcgcacgatggaatcatcaaccatgacgacccgttttccttcaacaacaccgcggacggcggacagcttcattcttactccttgctcacgaagagcttgagacggctggataaacgttctgccgacgtaacggtttttaatgagaccgagttcgtacggaatgcccgttgcctcggcatagccgatggccgcggaaatactggaatcaggcacgcctgtgacgacatccgcttcaacagcggactcttgggcaagcattttcccgaggctcttccgggcgctgtgcacgttaatgccgtcgatattgctgtccggacgggaaaaatagatatactccatgctgcagatagaacggttgatattcatggagaaacgctctgatttcaagccttcatcgtttatgataagcatttcgcccggttctacgtcacgaaggtacgtggcgccgaccacatcaaatgcgcatgtttctgatgcgacgacgtaagcgtcgccgagcatgccgagtgaaagcggtctgagtccgttcgggtcaagcgctacaatcatttctgtttctgtcatgattaaaaaggcgtaagcgcctttcagcatggatagcgaatttttgatctgatccttcagtgaaaagtggccgctgcgtttaatcagatgagccagcacttccgtatcggaggaagtctgaaagatgctcccttggttttcaagctgctgtttcaattgtgtggcattgaccaggttgccgttatgggcgagcgcgagactgccgttgttttgcgaacggaacaggagcggctggacattttcatatccgccgccgccggccgtcgcatagcggacgtgaccgatcgcgcctttgcctttcactttgctcagttcgccgttttgaaaaacctcggtaataagcccctgccctttatgagccgtcagtttttggccgtcggtcgccacgatgccggcgccctcctgccctctgtgctgcaggctgtgcaggccgtaatacgtaatctgcggagcctcttcatgcccccagatgccaaacacaccgcattcttcattcaggcctttgatttcagcaagcatggaatagctcctttccacgcgcgctcaagttctttcgtttgcgcgtgaaccaattgttgtccttcttggcttcggatcgtcaactgtccgtcccctgtcacttcaccgatatgaacggcatctgccgcagccgcttcaaacgccgccttgttttcttcctttacggaaacgacgaagcgggattgagactcactgaacaaaagagccgcttcattaaatgccgtgatgtttgcgccgagtccgtctgtcgtcatgacgctttctgcaatcgccacacccaatccgccttctgacacgtcatgcgcagattggaccagaccttgtttaatggcgttcagaagcgatgtttggcgggctttttcaacgtcaagatcaatttcaggcgctttgccatagattttcccttcagtcattttctgaagttcacttcctgcatactcaggcttcgtttcaccgatgacgtaaatcaagtctcccgccgctttgacatgctgtgtcgtaatatgagccgtatcttcgattaacccgaccataccgatgaccggcgtcggatagatggccgttccgttcgattcattataaagtgatacgtttccgccgatgacaggtgtgctgagaacattgcatgcctcgctgatgccgtcggccgctttttcgatctgccagaaaatttcaggtttttccgggtttccgaaattcagattatccgtgaccgcaagcggctcggcaccggagcaaacgatgttgcgcgccgcttcggcaacggcgatttttccgccttcttcaggatcgagatacaaatagcgggcgttgcaatccgtcgtcattgccagcgcctttttcgtgccgcggattctgagcactcccgcgtcagagcccggagccaccaccgtgttcgtgcgcaccatgtaatcatattgatcgtacacccactctttgctcgcaattgtcggctgctgcagcagggcaaaaagcgtctctgtcgcgtcttttacttcaggcgcgggaacttcagtttcctgaaactcgcggtagtacgcgggttctgctgacggcttatgatatacaggggcttcttccgccagcgcgtcaaccggaagctcgcaaacaacctctccgttatggcggaggcggagcattttatcatccgtgacatgacccacggaaaccgcttcaagatcatatttattaaaaatatcgacaatttcctgttcacgcccgcgttcaataacgagaagcatgcgttcctgagattcggaaagcatcatttcataagcggtcatacccgtttcccgctgcggaatgagatcaaggttcatttcaatgcctgatccggctttacttgccatttcagcgcttgaacttgtcagaccggccgctcccatatcctgaatgccgactaacgcgtcgcactggatgacttccaggcaggcttcaagaagaagcttttccatgaaaggatcgccgacctgcaccgcggagcgtttttcttcagatgaatctgacatttcttctgatgcgaaagtagcgccgtgaatgccgtcgcgtcccgtcttagcgccgacgtacataaccgtgttgccgacacctttcgcctggccttttttaatatccttatgatcaattaggccgacgcacatggcattgacaagcggattgccctcatagcttgcgtcaaactgaacttccccgccgaccgtcggaatgccgatacagtttccgtatcccgcgattccagccactacttcttcaaacaagtacttcacacgcggtgaagtgagttcaccaaatcgaagagagtttaatacagctatcggacgggcgcccattgagaaaacgtcacggatgatgccgcccactcccgtcgcagcaccctggtatggctcaagcgctgacgggtggttatgcgattcaattttgaacacaaccgcctgattgtcaccgatgtcaacgatccccgcgccttccccgggaccttgcagcacgcgttcgccgcttgtcgggaatttgcgtaaaatcggcttagaatttttatagctgcagtgctctgaccacatcacggaaaaaatcccgatttccgtgtagtttggcaatcttccgataatagattcaatgagtgcgaactcgtcatcactgacacccatttgctgatagagtttctcttcttttatttgttctttacttggttcaagcagtagcgacatgaatttccctccaatttttcacgatagactggaacaatgtaagaccgtctgcgctgccgagcagttcatcgaccgcgcgctccgggtgaggcatcatgcctaatacgttgcctttctcattcacgacgccggcaatgccgctgacgcttccgttaatatcgccgccgtatgtgaaagcgatttgattgttttcttttaatctttcaagcgtttcgtcatcacagtagaaattgccttcgccgtgggcaacgggaatcgtaattgattgtccctctttgtaggaagaagtgaacattgtttcaccgttctgcacgattaattcaaccgggcggcaaatgaattttaaatctttattgcgtctcatggcgccgggcagcagaccgagctcctgcaaaatctggaatccgttgcagacgccgagaaccggttttccttcagcagccgcttttttcacggccggcatgatgttggcgaatctggcgatggcgccgcatctcaggtagtcgccgtaagaaaagccgccggggatgagcacgccgtcaaatccgtcaaggcttgtttcctcgtgccagacatactccacttcttcgccgagttcgtcctttacggcgtgatacatatcaatatcgcagttagagcctggtaacacaatcaccgcaaatttcactgtgcgacaacctcctcaacttcatatcggtagtcttcaatgactgtattggcaaggagcttctcacacatttctttcacgagttcatcaagatcgcggtctgatttttccagcgtcagctccatgtattttccgatgcgcacatcctgcacttcattgtaggtcatgctgtgcaatgcatgctgcaccgcgcttccttgaggatcaagcacactttcttttaagctgacataaactttcactttatacattatgaaatgcctcccagtcttttgaaaatctcttcatatgcgtcggttaagcttcccaggttccgtctgaacaaatctttatcgagcttttcgttcgtgtctttgtcccacagacggcacgtgtcaggagaaatctcatccgctaaaagcacccgtccctctgcgtctaagccgaattccagcttaaaatctattaatctgacaccgcagtcttcaaaaataagctgcagctctttattcacctgtcttgtaattgatttgatcgtttccacctgttcggatgaagctgcttttaacagccagatatgatcttcggttatgagcggatcaccgagtgcgtcatctttatagtaaaattcgataatcggctgcggaagctctgttccttccgggatgccgaggcgtttcgacatgcttccggcggcaatgtttctgaccacgacttcaagcggaacgatgcttacttttttgataagctgctctgattctgaaacacgctccacaaaatggttgtcaattcctttggcgtgcagatgtttgaagatcaggcttgaaatttcattgttcagacggccctttccagtgatctccgcttttttctcgccgttaaaggctgttgcggaatccttgtagaccacacggagaatctgttcgtcctcagtttgataaattcgtttcgcttttccttcataaagaagattacttttcacaatattcacggaaggcctcctaacccgaatgttgggaatattcaatctatggcggctgaagaagccgcctccggctggcttcttctataaacctaaacgatcaaagatcaagtcgacgtttttcaaatgataattgtagtcaaagcaatcggcaatctgttccggtgtaagacgggacgtgattttttcctccgcttcgacaagctgacggaacggcacttgtttttcccacgcttccatcgctttcggctgaaccgtgtcatatgcttcttcacgaggcagacccgtgtcaattaaagcgagcagcacgcgctgagaatagattagacccagtgtgcggtccatgttgcgtttcatattttccgggaataccgttaagtttttgacgatattgctgaaacggttcagcatgtaattcagcgcggttgtcgcgtcaggaagaatgatgcgctcagctgatgaatgagaaatatcacgctcatgccataacggaacattttcgtatgccgtcagcatgtatccgcggatcacgcgcgccatccccgtcatattttcagacccgatcggattccgtttatgtggcatagctgatgagcctttttgtccttttgcaaaaaactcttccacttcccgtgtttcactcttttgcagaccgcggatttccactgcgaatttttcaatgctcgtcgcgatcagggcaagtgccgccatgtaatccgcatgacggtcgcgctgtaatgtctgagtggagatcggcgccgctttcaggccgagtttttcacagacatactgctctacgaacggatcaatatttgcatatgtgccgaccgctccggaaagcttcccgacttcgattccttcttttgcctgcttgaaacgttcaaggttgcgtttcatttcttcgtgccacagcgcgagcttcaggccgaatgtcgttggttctgcgtgtacgccgtgtgtgcggcccatcatgaccgtgtatttatgttctttcgctttttcttttataatgtcaacaaatctctcaatgtccttgagtaaaatctcattcgcctgttttaatagataggaaagagcggtatccacgacatctgttgacgtcaggccgtagtgaacccattttctttcttcgcccaatgattctgaaaccgcgcgtgtgaatgccacgacgtcatggcgcgtatcctgctcgatttctaaaatgcggttaatgtcgaaagacgcgttttctcgcatgactttgacgtcttctttcggaatgacgccaagttcagcccaggcttcacaggctaaaatctcgacttccagccatgcctggtatctgttttcgtccgtccagatcgcggacatttcaggtcttgaataacgttcgatcattatgctcgtcctccgtctcttttcatccatatgttcgtgatgtcctgaatccatttttcatcaggctcccgcaaaaatgtcatatgccccattttgcggccttttttaatctcatgttttccgtacaggtacagtttggcttcctttaaaagctccgtatgctcctccgccagcttcacttcgtcaccgagaagattcaccatcattcccggtttaagcagatcggttctgccgagaggaagtccgcagaccgctctgatgtgctgttcgaactggctcgtttcacaaagatcgagcgtataatgccctgaattgtgaggacgcggcgccaattcattaatcaaaaggtctccgtcttccgtgacgaacatttccaccgcaagcggcccgacgagctccagtttctccgcgagctgaacggcaagcgcctctgcccgcttttgaaccgtttcctccgctctcgcgggcacgatgctttggaacagaatattatggtggtggatattttcagcagcgggaaaggttgaaatctctccgtgcaccgatctcgtcacgataacggaaagctccattcggaatgacacccagctttcaagtatgcacgcgccgttttctaacagtgcggccgcttcatctgtctgtccttcttccttaatgacaaattgacctttgccgtcatatccgccccggcatgttttcagcaccgccggaagacccaatgactgaacggcttcctcaagctcccgtctgctgtttacgatccgataaggagcgacctgacatccggctgactggatcgcctttttttccgtttccctgttttgggtgatgagcagcagctcgcttccctggggaagatatgcatgttctttgagccagttgagcgcctcgtaatcgatattttcaaattcgtaggtaatgatgtcactgactccggccaatttttgaatcgcttcacggtcattgtactgggcggtaatctcaatatcggcgatctgtccgcatggcgagtcttttacgggatcgacgactgcgactttataccccatctgttttgcggcgacagccatcatttttccgagctgtccgcctccgataatgccgatgacggcgccgggaaaaatcgtttttttatcagacaagctgatcactgctttccagcaccgtttgttttgtcgcatttcttctcgcctctagtttatccgcaatgtcatcgtcaaatgccgacaaaatttgcgcggctaacagacccgcgttcactgcgcccgcttttccgatcgctgtcgtcgcgaccggcacgccgccgggcatctgtacgatagacaaaagagaatcaagcccgttaagcgattttgtctgaaccggaacaccgatcaccggcagtgtcgttttggccgccgtcattcccggcagatgcgccgctcctccggctccggcaataatgacttttaagcctctgctcctggcgctttctgcatattcaaacatcaaatcaggcgtccgatgcgcggataccacctgtttttcataaggaatgtgaagttcgtcaagtatgtcgcatgcatgtttcattgtctcccaatcggaggtgcttcccatgatgattcctgctagcggctgcattctgttcccaccttctcatgctttgtttttcagaaaaaaaagcccggctcgtattgcactatgaggaagcaatacaaaccgggcatggcgcgtatcggcagtcgttcgcttctgcgatatccatgtcagctgtttatcactttcctgcatagtccggccgtttacggcagccgggtagaaacttatgggccatattcccaagattatatgaggtcgtgttttgatttcatgtttatcttaacaacggacttggataatgtcaacgacattatcgaacgatataaaaattctttcttttaatgttcgtgtttagatcaatttcccttcaaatacgatttttctcccgcaaggaacgacttgaattgatccattttctttcttttctgtaaagatcggctcttccatccgccggacgggcatatacccctcttccttcattaaagcgagaatggtgtcgatcgtttcatgttccgttacttcaaaccgtttcttttttggctttgtcattccttaattctcctcttcttcactgctttcacccagaatccgccgtggatcgttttcggctcaaaggcgatgataaacgctttttcatcaagcgttttaatcgtatcataaagctgaagctcatatttgcgcggcgtcagaatctgcatggcggtccggtctccttcaagtccgcccgccacccagcttgtgaccccgtatcctttttcccggagctgtttcggcaggtccagatcaagctctttcgtaatgacgttgactgtaatatagccgagcgccagtttttcttcaattttcatacccactatgacgccgaggccgtagccgagcgcataggcaatgacgttttgaatttgattcagattgccgagcacgagactcaagccggtcacatacacaaggatttcaattgtactgatgcctgcggcgaaatagcgctgcccctttaaggtaaggatcatcctgatcgtaaaaaaagagacatatataatgttaatgatgagaataatgagaaccatacctatactgttggataaaatcgtctgcatcattgattccccctcctctgatctttgaaaaaactgaccgggacggccgcgtcaatctttcaggttaaggatagtttaccctcttttgatcattttcaaaagaaaaaaaagcccgccccggaaggcagactttcaaactcttatcagtgaagctcagcttttttcaatcgtttgacggcttcatattccttttctagttcactcagcgtatatccggacagttcctgaacatggttttgataaaaccctgaacggatcagctttgtcctcagatgctgttttttccgattaatggcttctcgcaacaacggggccatcctcatcatcctttccgaatcataaagattaatgccgttttcaacttgctgttgctcccatcatatatcggccggctgctcaaaacaacacgctttattagaaatatttgtaaacattgtgaaagacaaatttcgacttataaaggaatcagtgaggcggtaaagtactctgaaataagcggccatgtcacagccgtaaaggcgagcatgatgatgaccgccgcagaaatacagtacatcacgtcagccgcaggcttttcagccgatttgtacaggatctgcacaaactggaccattgccgaggcggccagaaacaaggtcagggccgtaaacaccacggtgatgaccggcagattcaatatcgcgaaaatcatccatactatagagcaggcgacagccggaaccaaaagcgaaccgactcctgccgccgcagcccgcatcgtaattttctgtttcatcatatagcgtgatacaagccagaccgcgccggccgcagcggctaaaaagacgagcgaatacacgagtacgacggtaaagccgtcaaaaaacgtatggtgccgttccccgtaaccgagcggtctctgctggcttgccctcagctgaaaccaatttccgattgagaaaaagatactgaatacaagcattgaaataagagcatatttaaagcgggaaaagccgtcttccccaacgacctttaccggtgatgtcaaaatgcgcagcgcgaaacggcagtaacgtttgaccgcagcccaagcagaagcgagtttttccgtaaaagccggagccgggcgccgttccttttcttttttcttttgcttttgataacgtcccgcatttctggacattctcgacagcggttcttcatcagttccctgatgctgtttttcttcttccaacgtttcttttctttcttccgtcatgtcagcaactcctatcaaaaaaatacggcggaatttgttaagcaagaaaataaaacacttatataaggtaccgaagcgtccttaaacagtcaagcggtttcttcacccggacacccacatgacgttttatcttatgtattggttttacggaataggacaaaaacaaaaaaccggctgtcctcagccggtttttccgttatttcaagaagatgaaatacagtataaagataacgaacagcccgtacataatcgggtgaacgctttttccttttcctttgcagatcattgtaatcgggtagaaaataaagccgatcgcaatccccgtcgcaatgctgtacgtcagcggcatcataatcatcgttaagaatgccggcacagccacctcgaatttatcccaggcaattttaccgagcggcgccaccatcagcgcgccgacaataattaaagccggagccgtcacattcgtagtgacaactgacagaagcggcgagaaaaacatcgccagcaaaaagagaatgcccgtcacaacagccgcgaatccggaacgcgctcccgccgcaacgcctgagcttgattcaacataagaagtcgttgtagacgtaccgagcaccgctccgataacgattgaagttgaatccgcaagaagcgctctccccgcacgcggaagtttgttttccttcatcagccctgcctgtgtcgccacagccaccagcgttccggccgtatcgaaaaacccaacgaacaggaaagttaaaatgacaatcagcatttggacggagaagatatccggaaggtgcatccatgcctgtccgaaagtcggcgcaagactcggcacactgccgacaatgtgcgtcggaaccggaatcagcccgcagatcatgccggcaaccgccgtcagaagcattccgataaacacgccgccgtttacgcgaagcaccatcagaatgaccgtcacaatgacaccgaaaaccgtcagcagcacaggaccgctgtgaatattgccgatagacaccaaggtcgatgagttcgcttcaataatgccggaaccttgcaaaccgacaaatgtgatgaataaaccgatacccgcgccgaccgccaatttcagctcgggcggaattgcattaatgattttttcccgcaatcccgtcagcgaaagtgccacgaaaataattccggaaatcaaaacgccggaaagcgcagcctgccaggaaattcccatgccgagtacgacagagaaagcaaaaaacgcgtttaaccccatacccggcgcaatcgcgatcggatacttggctatcagccccattaaaatacagccggccgcagacgcaagggctgtagcggtgaacaccgcgccctgatcaatttttaatgcttccggaaatcctttcacaccgtttaaagacaatgtcagcggattgacgaacagaatgtacgccattgacaaaaaggtcgttaaaccgccgatgatttcattacgatagcttgtccccagctcattaaactgaaaaaattgcttcaagccaattgcctccttcattctctcccatttattctgcccgttatccgccaaataaaaaacgccccaaatacattgggacgcttgactacatacgttcagtctaaataaataagaatggattatttatatcaaacgattgagattgatccgtagtcaagccatttacggtagcttggtagaaacttgcgggccatatccccgccattatacgatatctgcatatttgatttctgagtctattgtatcaatacaattttgaaaactcaatataaaaaacgaacaatcccgtttaaaaaaattagtttattcgttaattgaccaaaaatggaagacggcaaaagccgcctccctgacatcattttccgtccgcaggccgtaccggaaccgcgaatgtgatcttgccgtcacctgctaaaatgttcataaccgtttgattgacatacaaagcatatgaatcgaatgagaaatcgcgcaatgaatagtcattatcagatgaatcatccaattcaaaaacggattccatttcacccgttttaagattcgtgactttcgccttattccccttgagataatagcccttttcatatttatcaactgatgaccaagttttcatttttttcgtattgccgagaccgattgactcaccgacattcatcagctgatcttcatccgtcttgcttacattaattccgctgaattgataatcgacgatcacccgtctgccttgctgtttgatctttttgatggtgatgccgacatggtgatgtttcgtttcatagctggcgggcagttttgttttcagagggacgatttctcccggctctgattctgattttatattacccgttatgaaaagtgttttcgctttcgggtctatcggtttgctgaattgagtttggccgcgtattcttttcccgccgccgggaagattttctctgctgccaagttcaatagccgacgtcgtcatttcataatggtttcctgcatcatccgttgcttcgtaaatcgagatggcatcatttttggctgtatcgtgaaagtcaactgaatatatgagagccgatcccatcgttccgttttccgcccggatatcgaaaaagcggtataattcgttatttacattcacagctttcgttccttccagggaaactgacttttgctttttgatcgggagtgtaaagcgccagtttcccgggatgtccttgatttttgtaatgacaagcggaagcttatcaccgtctttcagccttgagccgtccgtgaacaagcgaagctggcccccgtaccgcccgtctttcatttttttcatatcagtcctgtcataatcctcagataacatattccgggtatttttataatcgacttgaaaaggaatactctcctcatctgatttcaaattgtcaacgataaagttataaacgagctgtccgctgtcgtaatatacactttttactgtaaccgtgatcccgcgtgattccgctttctcgttcagttttgtcaccagattgcttttaaacagcgcagaacctgccttatcctgaaacagactgtaaatttgtccggcaacaggaatgtttcccatagccgtattaacggagggcatgaacaagcctgaggacagatacagaaaaaacaaagcagcagcaaccgcgaagccgtttatcagttttcttccccatctccgtctgacggcgccttcttttccggcacggacagccgcgctgtgtatcacgtttttcaattcagctttcggcacgtcaatgtcctgatacaattgcttcatttgatgcttttccatatttgtttatcctccttttccagctcttgcttcaatgcttttctcgccctgtgcagatgcgtttttacggtgccttccgccatgccggtctgttcagcgatcatggaaatcgagaaatcctgaaaataataaagctgaatggtcagctgtatatgttcatcaagtgtttccagagcatttcgaaggtctatgtattcttcaacgttcttgttctccgcacatgtatcgtggtgcggctcaaacgggatgacgtcaccgtgctttttcctcatcgcaaaaatcgtattaagcaaaatccggatcagccacgttttaaaatatttcggctccttcagctgcgcgatatgaagaaaagccttgtaagccgtttcctgaacagcgtccagggtgtcttctttgtgatgcaaatagagataagctgttttatataaagtctcctgatgagctgtgatcagtttttcaaaggctgaggcatcaccttttttcgcctttttgatcaatcgttcttccttcaccttatccacctcctatgctgttagatacgaatcggggcgaaacggtttcaaaaagatgacaaaaaaaacgcctcttttttaaaaagagacgttttttatcttgatttattcccactcaatcgtcgcaggcggcttacttgtaatatcatacacgacgcggttgatgtgtttcacttcattgacgatacgtgtcgaaatcacttcaagcacatcccaagggatacgcgcccagtcagatgtcatgccgtcgattgaagttacggcacggataccgattgtgtaatcatacgttctcgcatctcccatgacgccgacgctgcggatgtcaggaagaaccgtgaagtactgccagatgtcgcgctcaaggccgtggtttgccacttcttcgcgcagaatcgcgtctgattcacgaacgatttcaagtttttcttccgttacttcgccgagtacgcggatgccaagaccaggtcccgggaacggctgacgccatacgatatcatccggaatgccgagctctgtgccgagcgcgcgcacttcatctttgaaaagagtgttaagcggttcgatcagttcaaactgcatatcttcaggaagaccgccgacattgtggtgcgatttgatcgtttgcgctgttgccgttccgctttcaataatgtctgtgtaaagcgttccttgcgcaaggtaatcgattcctttcagcttgaccgcttcatcatcaaatacgtaaatgaattcgttgccgatgattttgcgtttttgctcaggatcagaaacacctttcagcttatttaagaatctgtctttcgcatcaactttaatgacattcatattaaagccttcgctgaacgttttcatgacgccttccgcttcgcctttacggagcaggccgtggtcgacgaaaatacaagtcagctggtcgccgatcgctttatgaatcaaaacggctacgacagaagaatcaactccgccgctcaaagcgcaaagcacttgtttgtctccgactgtttcgcggattttttgcatttcgatttcgataaagttttccattgaccattcgcctttacattcacaaggaccgaagacaaagtttttcagaaggtcatttccgtattctgaatggcggacttccgggtggaactgaacgccgtaccattttttgtcttttttactcatcgctgagttcgggcagtgatggcttgtcgcatctaccgtaaacccttccggcacttgtacgactaagtcgccgtggctcatccataccacttgttcttccggaagatctttgaacaggtcaggagttccttgaatctgaatgttcgcttttccgtattcgcgctggcttgccgcctcgactttccctccgaggtaatgagtcatcagctgcataccgtagcagatgcccaatacaggaatatcgagttcaaagattttttcgtcacagcggaaagatccttcatcatatacactgttcggtccgcctgaaaggataattccttttggattcatttctttgatttcctcagctgtcaacgtatggggatgcagctcgctatatacgccaaattcacggatccggcgggtaatcagctggttatactgactgccgaaatcaagaacaagaatcatttcattcactaacttcgtcatggttgtcacctaatctcctctaagtttttgacacagaaaaaacggaggacacacgttcagccctctgtcgcgcaagacttgtccggaagcccggctttttaacgctcccgggctcccatttaacattcatttattctaacaacaggacgatatgcggtcaagactatcttgttttaattatattttcccacaactgtaccgattcattccaaagctctgcggcattatcgctgcggtataaagcacgctcatagcgcagcgtcagctcggacatgtcgtctgtatggtacgcctcatcaatcctcgcggcaaaatcacggagcgtttctccgtctcccctgctgaacccttttcgtttcagctggcggagcagcgcggcatatgcgtcgaaaaagacgtcttcatccgtgcgccgcttcaatctggctgctgcaacatgcggaatccagcgcgcccgcagcacccagacgagcgcggccgcggctgaaatcacgatgatgatagctgcatacggccacagctgtgccgcggttttattgtgcatcacaggatgcggagccgcactgtgctcccgctttttcggcgtttcttttttttcgggctttgtttcctggcgctgcttgtcagacggtgtatccgaattccccgctgagcttccgccatcttttcccgctgtatgattctgctctgacgtaaactccgtcggattggtgaagcctttcgtcggctcaaacgtcacccagccctgatccggaaaatatacttctacccacgaatgggcattgttgtttgtgacttcataaagatggccgttttgatcgcccgcgcctttatattctccggatgtatagcctttcacccagcgggcgggaattcccgcagatcgcagcagcacagccattgccgaagaaaagttatcacaataacctcttttcgtttcaaacaaaaattgatccacataatcctggttgtgctccggaacggcgacatcctgtgtatcatacgaaaatgcggaagatcccagataatcctcgaccgccttcgctttatcgaacatattatgatgatcccgcgtcagcctgtcggcaagctgtctcactctttccggaaggctgtcgggaagctgcagataccggtcattgaattgattctgctcacggtatcgtttcactttcacttttttgaggtcattcagtttaaagacgggcgcgtgaaaagtcaccgtgtaccgtcccatattgcggatgctgcccacttgttcactgatcggcgtgatttgctcggtgtttccgttcatttcaagctgaatcgagtgcttcggtttaatattggagacgccgatcggatacatgacgtgattataaagataattctcatcaatggacacctgcgccgtataacgtctcgtctgcacactccggtcaaaccatatatcttccacattgccgccattcagtttataggacatgccctgatcggtctccacccagccttttcccgtgtatgtatccttcgtttccacccggaagtacgcccgctcttttcccttccatgtgaaaaccggcgtatcgtcctgctgaaaaggcccgcctaatgtttcatcatggttgccgtagccgattttgctctcagcggcgggcacctctttgtgatttgttatttttttcagaaacggcacggggtccggccagttcggatctgatttcggagccgccagaccgaataggacggaagcgcagataaacagcgccagcggcagaaaccatttgatgatcaacctttttttaaacgctatgtgttccgtcaggcggatgcgctccatattcaaaagccccatcatcaaaaagccgataaagacaatccggatgacggcgtatgcggcatcatagggagtaaacgtatcaagcacggtgatataggccaccgtcatgataaaaaagaataatattttccgctgatagatcacccagtaatgcagtaaatatacgagcagccataatagcacaaaaaacagcaatgtgcggaatgacgggttcatatcattccatcttccggtcccgatgtgccgggcattcagcatcacgtcccgcaaaaaagaagcgagccattccggctgaaaaaccgaacctttataaaacagcatatgaatactgatcaacgtaaacagaatgcaggacggcacggtgacgtaccacctcatccggaagaatgacagcagaaatgccaaaccgataaaaatgatgaaaaaaccggtatgttttgtatccgtaaaattgtgcagcggcctgagccattcccataacaataaaaaagcgagaaaataaaacagcagcagactcagcctgcttccctggttctcgtcatgcggcatggcgcgccacctctctttctaaacaacatgggacacccgtttgtccctgatcatttgcaccttgatattcttctgagcgaagatgagagcgagattccgttctttttccgaaagcacggcattcgtttctttcgccaaaaacaccgtcatgtcaaaaggtcctgcctcagcctgtttgagaagctcttctgtaaggctgcccgtcacgacggcaataaaagctttgcggacacgcggatctgccagctcttttcttaagcgtccgccggcatcagcttcttccgattctgaaactgcagccagataacgcagcacatttctgaaatgctgctctccctcccggacgggaaaaacagtccggtcgttccccaatgaaataaaccccgcgggagagcccttcacaagcgccgtgtaaagcagggatgccgaggctgagaccgcggcttcaaacgaaggggacggcgtgcagtccaaaaggagaaccatattcatactctgcaaggggtcaaattccttcgtcatcagctcattgcgccgcgccgatgttttccagtcgagtgcggaaaaccggtcgcccggctgataatttctgacgctcgcggccattgcggagcggtgagtctgaaacggcgcgccggcacccgcaccctcttctccggatacggtctgcgtcttataatgtacagacccgtacgccgggaaaactaagaccgtatccgttaccgaaaacgaggccgtcttgtccaaaagcccgagaacatctccggtccgcactcttatcgtatgtaaacgatgctctccgcgcggagcctgcggcagctcatattgaaacgtcagctttttttgaaaccacggaaacacgagctgtttcgcacagcgcctctcgccaagcgtttccggcatcacatcttcaatgaccatataagtcagcggaaacggcaggcgcctcgtcagcctgatggtgacagacagcctgtcacccgaggttaattgagcagaagaaatctcacgcgtcacccgaaacgcccgcagcggatacacagcgaccagcccggcgtaaacggtaaacggcaaaaacgcataaaataaaaaccagctcacaaatccgccctgaaacatggcataagaaaagaccgctgccgtcaatacggccaaaataagcagcttccagccgtatagcagccaatgcactttctttctcattatcggaccgacatcctttgaacgggaactttttccgtctgcatgatgtcttcgatcacagcttccggcgtgacatcattaaatttcgcctcggccgttaagatcattctgtgaggcagcgtatacggagccaaatactggacgtcatcaggaatgacgtagtcgcgatcatgaagcagcgcgtatgcctgtgcggctttcattaatgaaatcgaaccgcgcggacttacgcccaaatgtacggacggatgccggcgggtatgctgagtgatgccgacgatataggctttaatgccatcatccacccgcacctgctccagcttttgctgaagactgataaattgttctttagaaatgacgggctcaattgtttcaagcggattgcgcccttcctgcaaagacagaaccttaagctcctcctcggcagtcggatagcccatcttcagcttaaataaaaaccggtcaagctgggcttcaggaagcggatatgttccttcatattcaaccgggttttgtgtggccatgacgaaaaacggctcagccagccgcattgtctttccgtcaatcgtgacatttccctcttccatcgcctcaagcaaagaagactgcgttttcggagaggttctgttaatttcgtcggccagcacgatattccccataatcggtcccgggcggtattcaaattccatcgttttcgtattataaatagagacacccgtcacatctgacggcagaagatccggagtgaactgaatcctcttaaagtcagctccgatcagcttggccaaagcgcggaccatcatcgtttttccgactcccggcacgtcttccagcagcacatgcccttttgcgagaatggcggccaagctgagtatggcgatatcccgttttcctatgatgatgttttcaatatgctcaacggctttctccagcagcggatgcagctcttctttataagccattcttctcctcctagtcatctctcaaatttcaattatcgtaacctaactttaccacaaaatataaacagtataaaaaaacgtttccagcgaattgtttccagtccgcaaaaggaaaaaagctccctttagaaaggaagctttatttcagctggagaggctccatatgaacatgtgaatggtcgatggcatgttcatctttcatctttcgttctacctcatttgcgatatcatgactctctttaatattcatatcagacggcacttcaatgacgacatcaatatgaacggagctgcccagatatctcgctttaatatcttttaaacggctgacgcccgcaatctgttcgatcgtctttttataatcagaaatatttttgacatcaaaaccgtcagtcagcgaatgagaggattctttgaaaatatcccacgcggttttgcagatgatcaatccgatgataaacgccgtgaccgtatcaacccaagccaaatggaactgcgaagcaaaaattccgataaacgtgccgatactgacgagcgcatctgatttattatcagcagccgcggctgaaagggcttggctgtttacctttttggcaagcccttttatatagcggtagacaatcagcatcacgacggcgctccccgcagccgtccaggcagcaatcatatccggtgtttcctcttttacggaaaaaatagattgtgcggcgctgaacagcacttgcattccgacaagcatcataataatggaagcgataagtgacgcgacggtctccgcccgaaagtggccgtaaggatgatcttcgtcaggaggtttctgagagatgcgcaaaccgatgaaaacagcggcagatgccacgatatcagtcgtgttgtttaaaccgtcggcttgaagcgcctctgagtgaaacaaatagccgatcacaagcttcacagccgacaatactgcatatgcggcaatactgacaatcgctccggtttcgccttttttcaattcatgatatctctccactgaaaaccctccttcccgttcattttttccttcattatcatacaaagcgaaggcacagtgggtctatagaaacatgattcactttccacagaaaaatagtaatcatagaacatttgtgcatacaggcaaattatttttattcacgaaaccccagtcatcccaatcgtaccaaggcttcttgccgctctgcttatatggaattattttcaataccatcaaaacatataaatcacagaaaattatttcttttccttctgctgtacgaacgagaaaaaatgtcatattttcttacatcattttcaaaagtcatatgtatttatgataaaataaaacttgtcggaatattcagcataaacaaattaaaaggaggcaaagaatgaatcagcctaattctttatcgaagggattaaaaacccggcatatgacaatgatttcaattgccggcgtgatcggcgccggattatttgtcggaagcggatccgtcattcattccaccggacctggagcaattgtctcctatgcattagcaggactattagtgatttttattatgaggatgctgggggaaatgtcctccgtcaacccgacaagcggttcgttttcacagtacgcacatgacgccatcggtccgtgggccggttataccatcggatggctgtattggtttttctgggtcatcgtcattgccattgaagcaattgcgggcgccggaatcatccagtactggttccccggcattccgttatggctgacgagtctgcttctgaccgtgctgttaacactgacgaatatttattcagttaaatcgttcggcgaatttgaatactggctttccttagtgaaggtggcgactatcgttgtcttcttaatcgcgggttttgcgtttattttcggcctcgtccccggcagcaaaccggtcggacttgaaaacctgacgggcaacggcggatttctcccaaaagggccaagctccgttctgctcggcatcgtcgtcgttattttttctttcatgggatctgaaatcgtcgcaatcgcagcgggagaaacgtcaaacccggtcgaatccgtaacaaaagcgacccgctcagtcgtttggcggatcatcattttttacgtcggctccattacggttgtggtcacgctgcttccgtgggattcagccaatgttctggaaagccccttcgttgccgttttaggccatatcggggttcccgcggccgctcagctcatgaatttcatcgtcctgacagccgttctgtcctgcctgaactccgggctttatacaacatcacggatgctgtattcactggcagagcgtaatgaagcgccgcggcggtttatgaaactgagcaaaagaggcgtaccggttcaagccattgtcgccggcacctttttctcctatattgccgttgtgatgaactatttttctcctgactccgtatttttgtttctggtcaattcatcaggggcaatcgcactgctcgtctatctcgtcatcgcagtctcacacctgagaatgagaaagagaattgaacggacaaaccctgaatctcttaaaatcaaaatgtggtgctacccatacttaacctacctgacgatcatcgctatttgcgccatcttgttatctatgctgtttatcagctcaatgcggtctgaatttctgctgacaggatttattacattagtggtccttgcctcatatgtattccacaaaaaacaaaaaccgaaagagaacgcttccgcaagccgggttgcgcaataaccgcaaacacccgccctcaaaaaagggcgggtgtttttttaaccaacctgttccagacagcattaactgtagtacaggatttcaataaatgataaggacaggatgaataatggcacttgaaaaatttgcagatgaactgccgattatcgaaacactgaagccgcagaagacatcaaacggcagcacgtattatgaagtcacgatgaaggaatgctttcacaagctgcaccgtgatctcccgccgacccggctgtggggctataacggtttgtttcccggcccgacgatcgacgtgaaccaagatgagaacgtctatattaaatggatgaatgacctgccggataagcattttctccctgtggaccataccattcaccattcagagggcggccatcaggaacccgacgtcaaaaccgtcgtccatttacacggaggagcaacgccgccggacagcgacggctatccggaagcctggttcacacgggatttcaaggagaaggggccttattttgaaaaagaggtataccactatccaaacaaacagcgcggggcgctattatggtatcacgaccacgccatggcaattacgaggctcaatgtgtacgccgggcttgccggcatgtatatcatccgcgagcgaaaagaaaagcagctgaagcttcccgccggagaatacgacgtaccgcttatgattatggaccgcacgttaaatgacgacggttccttgttttatccgagcgggcccgataatccttccgaaacgctgccgaatccttcaatcgttccattcctttgcggaaataccattctcgtcaacggcaaagcgtggccgtatatggaagtcgaaccgcggacatatcgtttccgtatccttaacgcctcaaatacgagaacattttccctctcgctcaataatggcggccggtttattcaaatcggttctgacggcggactgctcccccgttctgtcaagacacagtccatcagcttagccccggctgagcggtatgatgtgctcattgatttctccgcttttgacggagaacatattattttaacgaacggcaccggctgcgggggcgacgtcaatccggataccgacgccaatgtgatgcaattccgcgtcacaaaaccgctgaagggagaagacaccagccggaagcctaaatatctgtcagccatgcctgatatgacatcaaaaagaatacacaatatcaggacgcttaaactcacaaacacgcaagacaaatacggccggccggttttaacactcaataacaagcgctggcatgatcccgtgacagaagcgccgcggctcggctcaacggaaatctggtcgattatcaacccgacgcggggaacccatccgatacacctgcacttggtttccttccaagtccttgaccggcgtccttttgacttagaacgttataacaaattcggcgacattgtgtatacaggccccgccgtcccgccgcctccaagtgaaaaaggctggaaagacaccgtgcaggcgcactccggagaagtcatcagaatcgcggcgacattcgcgccttacagcggacggtacgtatggcattgtcatattttagaacatgaagattatgacatgatgagaccgatggacgtcacagaaaagcagtaatccccctttttgagaaggggcttttttatttatacaaaaagaaaaaataaggatccgcttatttgcatatactgtaataacaggaagacggtgcaccctcattggaaatatggatagaaaaaggaattaggagattagggaaaagtatgagacaatgaaggtgtgcacgaaaattcataagggaagaagtgactttatgtcttactacaacaaacgtaatcaggaaccgctgcctaaagaagatgtcagtacgtgggaatgcacaaaagaggactgtatcggctggagcagaaagaattttgccggcagtgataccccgacttgccccctttgcggcagtaaaatgatcgacggcgtccgttcgttggtgaatctccaaaacaacagtcaaacggcatcaagttagacctcccttttacgagtctcaacatagagaaggcctccatgtctcatgagaggcctttgcgttatcatgtccttttacgatgcaaaggagcaatgaacatgaaaaacgatcggcagcagaaagatctcaaggaaatggcaaaacagcagaaaatgaaccttgccgcacagtcattcatcgaatcactccattttgccgttccgattctccgttttttcaaatggctcgcctcagccgcagccagctttgttcattaaaaaacacccagcgggcgctgagtgtttttttcatgattggataacggaaaaactgttgataatgccattgtcattttcccagactttttcacattttttcgtatccaaatgataagcataaatggtcctgaccttcgcgttccgtcctgtttcatccttcagacgcttagcgcctttggcttccgccatgaaataaatgatgctgccgtctttagaaaactgaggctgggcatcaatcagcggagtgaaatccttcccgtttgagataatcgtttcatcttttttcgttttgacattcatcagacggatggacgctttttgttcagtccctttttgtgtataagatgtaaagacaagatttttgccgtccggtgacatcgcgatgtcgctgataaactgttcaaggtttgtcagatcctgaaggtgatcgcccgcccctgccgcaaaccgtatattcgtcggttcagggtcaacccccttctcatttgcctcatccgtttttttataatcctctttcacggaataatgcagcagcgcaaaatcgttttggctgcggttataaaagaagccgctcacactgtcgtctttctcatccgccgcagggtacaggttttgatagcgtttcgttttcagatcaaaagacgcgagacggaaaatatcttcatccgcttttccgagacggaaataaatgtgcgtcttatccttggataaaaacagactgtcagcgcttgccgatcctttataaagcaccgtcttctgtttcgtcttcagatcaagcttatacagacgcatctcattctgatcattattaccgacataatagagcacctgatgggcgtcatccagcgcaaacgccggatatgccgaaagcttttcctcgtacagcatacggccgtcttcgtaatatttcgtcatcagatctttgtctgtaatggaaacaagcagcttgtcatggccgccggagacaacggcttttccgcctccgtcgctttttcctttgatcagtaaaacggccgcgatgaccgccgccgccagaacagcggctgcgaggatccagatccatcgtttcttattcattatcaatctctccgtcaatcagaaaaagcaagaatagtctccttgctttttctgatggtctattttaatagctgtaatgtccggatactcttcctttgcttaacggatatccgagcgctttgaacgctttcgggctgacatccaatacggcattcggcagacggcctacatcatttttatatactgtgataacctttttcggttttgctttagcataagctctgattttcgttccgtttctcggaacgtcaaatcctaattttgtcgcgcaatcccaatgtcccagttttttaccggaagatccttttttaccgactccattataccatgtaatatttccgttcacttttttagcacttgcatcagaagagtaactgatcgctcccagcgtacttcctgctaaaatcaataatgctaagaataacttcttcaagctttcgtccccctgattctttattctaggcaaaattatacaccaagaagacgattataatatttcaatcactttacatgttcattacaacgcgacggagacacgcacacaatattgacacaatttccaattctatataatcccatggtaaattatactacaaaatttaattcataagcgttataatatccctagagtatttctgcattcaatatggactttttataaggcctattgatagttgcgtaatatgatatattttgagaaatcaggctttaggaagcactttttttccttttaaaccgtggttcatattgatcatgtacctatactcgtttccatcagactaggagtgataatcaatgaaagcggcaagatggcacaatcaaaaagacattcgaatcgaaaacattgatgaacctaaagcagaaccgggaaaagtcaaaattaaagtcaaatggtgcgggatttgcggaagcgaccttcacgaatatctgggaggtccgatctttattccggtcggcgaaccccatccgttaactaaagaaacggcgcctgtcacaatgggtcacgaattctcaggagaagtcgttgaagtgggcgaaggcgtcaaaaattacagtgtcggcgaccgtgtcgtcgtggaaccgatttttgccacacacggacatcagggagcctataaccttgatgaacaaatgggattcttaggcttagcgggaggcggcggcggattttctgaatatgtgtccgttgacgaagaattgctgtttaagcttcctgaagagctttcttatgaacagggcgcgcttgttgagccgtcagcggtagcgctttacgccgtccgtcaaagcaaattaaaagcgggcgacacggcagccgtttttggctgcggaccgatcgggctgcttgtgattgaagccctgaaagcagccggcgccacagatatttacgcggttgaactttcaccggaacgtcaggaaaaagcgaaagaactcggcgctatcatcatcgatccgtcaaaaacggatgatgtcgttgaagaaatcgcaaaacgcacaaacggcggcgttgatgtttcttatgaagtgacaggcgtccctgtcgttctccgccaggcgatccagtcaacaagcattgccggtgaaacggttatcgtcagcatctgggaaaaaggagcggaaatccatccgaacgatatcgtcatcaaagaacgtaccgtaaaaggcattatcggataccgtgacatcttcccttccgttctcgcactgatgaaagagggctacttctcagcagataagctcgtcacgaaaaaaatcgtgctcgacgatctgattgaagaaggcttcggcgctttaatcaaagagaaaaaccaagtaaaaatcttagtaaaaccgaattaaaccgttcagcaaaataaacagacacatccaaaaagagccgttcaggctctttttttcgtcccttcgtctttccttccttttccttttaaaaatgatccgctctgcgcaaactatttttcaccctgttccgtctatccataggtaacagcctatgatacgtatttttaaaaaaggagccctttaaagcaatgaagaacgaaacagccaaagcgtcgcttgtgacgtgcataactgagcgcaaagaagacttttaccgcctggcatacagttatgtaaagaacaaggatgacgcgttagatattgttcaggaatcaattcaaaaagcgctgacatcagtcgaatccgtcaaaaaccccgatgtgataaaaagctggttttataaaattttagtgcgtacggccattgattatctccgcaaacagaaaaaacttaaagtgatggacgatgaaacgatcgagtttttaagccgcggaaaggaagatcactacaaagacacggaccttcatgaagcgcttgacgacctgccgcatcaatataaaaccattatcattctgcgtttctttgaagacttgaaattagaagagatcgcggacattacgggggaaaacatcaacaccgtcaaaacacgcctttacagggggctgaagctcatgcgcattcagctgacgaaggaggatctttcttaatggaaaaaagattagaacaattaagagaagagtataaaagtgtgcccattcctaaagaactggacagcattgtcgaaaaagcccttcagcacaaaccgaagaaaaaacgaatcgtgatgtggccgacatccgcggcagtcgctgcggccgtcttatttaccgccgtagtcaatatcaatccggatgccgcacaagccatgtctaaaatccccgtcatcggcaaagtcgtccaagccatcacattcgtggagatgaaagaagaaaagaaccaatcaagcatcgatgtgaaaacgcctgctctgtccggcctttccaatcatgaacttgaagacagcatcaaccggcattatatgaaagaaagcaaagagctctaccgggaatttatgaaggcgacctcaaaaagcaaaaaaggccacctcagcatctacagcgattatgaaaccgtaactgacacatcggatctgatctcagtccgccgtgatatcgaaaaaacccaggcttcatcttatacccaaagccgatatatcacgattgataaaaagaatgaggccgtgcttacgttaaagagcttattcaaagatgaccgttatattaaagtcatcagccaaaatattaaagaacaaatgaaaaaacagatgaaagaagatccgaataaaatatattgggtcgaggaagatgatatgacggagcctttcaaatccattcatgccgatcagaatttttatattacagatcagcacaaacttttcatctcatttgatgaatacgaagtagcacccggatatatgggcgttacagaatttaaaataccgacctccgtcatctcaaagctgcttgtcggagaccgctacatcagataaagaaagaaaaaaatccatgatatccgcagatcatggattttttctttttccccggcaacagccgcttgcacaggggaaccctttcatataacagacgccggacgagggctgaaaagtttaagaaaatcacaacatttcattcattttttctgaaacaaaatccccttccgaatgcgtctatctaacggaacaaatggaagactgtacagaaatctgccataaccatccgcaaaacagcgagaatttccgcacacattattggaggaataccatgtcagacaagtcactgaatcatcgctatattcccggactggatggacttcgcgcctttgccgtcctcgcagttatcgcatatcacctgaattttaattgggccgacggcggtttcattggtgttgatatcttttttgttttatcggggtatttaatcacatctattatattgcctgcccaaggcaatgacatcacccttgatttgcgtgatttttgggtgcgccggatcagacggcttctgccggcggcttatctcatgattatcacgacagtcatttgggtcgtattatttaatagcgagctcctgcataccatacgcggagatgcggtctcctcacttttttacataagcaactggtggtttatctttcataaactttcttatttcgacagcttcggctctccttcgccattaaaaaacctttggtcgctggcgattgaagaacagttttatatcatatggcctttcctgctgcttgcaggaatgcacatatgtaaaacacgggcccggcttgcggcagcggtcacattcatcgcgttatgctcagcagtcgtgatgagtatgatgtatgtccctggcggagatccgagccgcgtttattacgggacggacacccgatcatttgaattgcttatcggctgcgctttagctttagtgtggccgatgaaacgattatcttccaaacggctgccgagcagcatgaaacacctgcttcacgggacggagcttgccgcttttgccgcgctgttgctatgcgtcttttacacggatgaatatgaacccttcctgtacaagggcggcatgcttttgatcagcatcaccgcagcggtccttgtcgcatgtatatgccatccgagcagttttttgggacatgtcctttcatggaaaccgcttcgctggatcggaacgagatcatacggaatctatctttggcattatccggttatcgtgctgagcacacccgtgcaggaaatcggaaatccggtttattggcattgtgccgtcagaatcggcgccactttcattcttgccgaactttcttatcatttcattgagaaaccgatccgcactgcgggcttcaggccttttttccgccgcgtgtttttgaaccgctttctggaatggaagacgtcctctgtcatcagcagaatgtcgctcggcctcattcttgccgccatcctcgtatttgcgggcgggctgtcaggaatagccgaggagaaaaaacagccgcaatggacatacgcgcaaagcgggcagcaagaaacagccgcctcttcacacaaaacggctgatcatgataaaccggcaaaagaagatgacagccagaaaaaatacggcggcgaaaaaacagacgccgcatcagacaaaaacaagaaagaatcaacaggcaaatcagatacgaagaaaaacgaagacaaaaaagagcaatcatctcaaaaaacggctgattcaaaacaaacacagccaaaaaaagaagtgctggccatcggtgactccgtgatgctcgacattgcgtcatacctgcggcagtccctccctcatgtcaccatcgacggaaaggtaggaagacaagtctctcaagcactccagctcacatcggaatacgcgtcatttaatcagccgaacaaagcggtcatcatcgagttagggacgaacggctatttcacaaacagccagattgaatcactgatcagctccttttcaaaagctgatatctatcttgtcaatacgcgtgtgccgcggcagtgggaaagcaaggtaaacgagtcattgcgccagcaggccgaatcacgcaagaatgtcacccttgtcgattggcatgcaaaagcattgcagcaccctgaatactttacacccgacggcgtacatctcatccctgagggatcaaaagcgctgacatccctcatcgtccaaaccatgaaatcatgacaaaaaaagaggcctcaaaaggcctctttttcgtatatcgtcaggcaagcttctgtccgcaattcgggcaaaaattcgcgccttccgttttcgttccgcagttcggacagaatttcggcttagccgctccttctgagccatttgccggtgccgtcccctgattctgctgattttgactttgctgcggctggttctgctgattttgattcatttggttcatcatttgatttgccatattcattcccatcatcatgccggccatatcggaggctgtgccgcttccgctcattttgccggatgacattccgtccgtcatggaaatctgctgatagcgattcacatcgcccaccatgccgtaagaagcgttcttcgtaatcatatcctgaacttcctgcggatagttaaagctcatgatattgaagcccgtaatcgacatcccgtctccgatcagctgcatatcaagatcttcttgaatcccttttccgatttcaaatgaattcgactgcagattgaacatgtcttttccttctctggtgatccatttcatcaaaagctgatcgagaatagacgtaatccggattttaatgtcctctactaaatagctgtctttgacacccgcaatcttatcaatcaatccgatgtagtcaatgaccttgaagttaaatgtaccgtttgcgcggatcggcataccgcccggcattcccgccgccggaatgttgatggcgttttttgtgccccacttcacggtgaactccttcgtattcacaaacagcacttccgcccgcatgccgctgttaaagccaaacttaaacccttttaacgtcgatagaaacggaatgatttctgactcgatatcataatcgccgtcatcacggaagatcccttcaatcttcccgttgtgtaaaaagatggcatcctgtcccggccggatgatcagacggctgccttttttaatttcacggttgttccatttatagaaaaccatgtcgtctctgaattcttcccattccaccacattcgctaactgatttctgaaaaaacccatgtatgctcaaatcctttacgtaaaatttaaaaacttcctttgcttccgctgtaagacgtgccgcccctcgtgactccgccgtcattgtcattatctttgtcaggctttctttctcttgtaacgtccgtccggatatatgtgtcgtgctggtccagcacttcagacgtatcgtgatccatatacgtgctgccggtgacggtgaccctgccgccggaattgtacaccatcacagtgacggcaattccggctgcggctgcggcgataatcagctgaaaccaccacgtgagcagcagattgtcagacttgttctcagggtttttccccatatctttgtaggacattttaatataagtctcaaacgccttttcgtaatggcctgcggaaatgtctgacgaaatcgtattcctgatcgtattcagccggctgctgttcaaatacgtctccgcctttttgtatccggagataaatacttcccgatctttcatatcaatggtcaatatcgccgtgcttccgtgaaaatgactgtcataaaaatcaccggcgtactgcgcgatgtccttaccgcccgttccgtttgcggtaagaataataaaatcggtatggcgctttgcccccagcttccccgccaattcctcgagtttcttagtttcatccttcgttaataagtgagcattgtcataaacatattgcttctgttcagcggcagacgctgatgtatgtaaagaaaaagacagcatcagaaaaaggacgaagcaaaagagacacgctttttttatcgatactttcatcaaaaaccgccccctatcataagtgagacgagtcttaatgctaaaaacgtgccggctgtaatgccgccgaaccacgcggccacttttccggcgctgatcggcggtttgccgacaaccttgcccgtctgcccgttcatcgcaaaaatgtgctcagtccgctcataatcatagctgaccatccagaccggaagaagcacgtaaaaactgctgagtttatccgtctgaatcttttcatctgtaatgtcagccgtcgtatagccggagaaggtggatctgatataagaatcaatataatggctgattttatccttcgcccgcggaaagagatcgtcatcggtataattgtacttttccgctatatatcccgccaaataggctgtattaaactccttcagctcactgtaagaataaggctccagtttgtccattaattcatcattcattttttctgaagcgtcgaccggaattttgagataatcaagattaatatcgcggtacgcgttgtaatactcggtctccgtcacccggtattctccatcatcatagtgatgcactctcgtacaaacggcattgacctgaaccttgctgtttaagtcaaacatccaaaacggcacgtacataccggttatgttcttcacccgatcggcattcataaatcccttaggtgtcaggcggccgtttctgcaccactttttaaaagcgctcatggcctcttctttgctgatcgtaaaaggaatcaccatggaaggcgcgagatttcccgataatcgatcggcgagaacggccgcacctccgcaaaacccgcacatcgttgcagtcgtctccgcctcagtcattaataccgcgccgcagttctcacagtgatactccttcgcctcattttcagaaaatctggtcgtaatatactctttaggcaggctttctatttgatcctgccgcccgcagctgcggcatgtcagcttgccagatgaactgtcaaagaccatatcatcgccgcagttcgggcatttataagaaatgatcattctgtttctctcactttctctttatatcggacaaagctcagcccgctgtctattgatctttactgaaaagcattttctgcttgagcgccgccagttcatcatcgacactgctttgattgctgtcatatttagccgtcagctcgtcaatatcgtctttcggagacgcattcagctccgccatcgcattggcatgatcaagcgcccggttgaccttgtcttccattctatcgaaagctgtcatcgattggcccgcatttgaaacagaggatcccagtttgttcattttctcctgtgtttttgccacagaccacttcgctttaatggcatttcgccgcgactcaagctccccgatatcggcaacaagcttgtcatgcatgctgcgcatttgagacgcgttggaagaagcaagctgataagccgtttgcagctcagtcagccttgattcaacggctgctttcctttccagaaatgtccgcgcatcagcttcatttccggcctgtaaagctttcatcgcgtagctttccatcttttcggcctcagcctggcattccgttaacgctcttttcgcccgctgttcctcagccatgacagaagccgtctccgccttcacttttcctaaatcactgttcagattccgcaaatattgatcaaccattttttcagggttctcagctttatccagcaacgcattaatattgcttgacataatgtctttaaatcgtcctaaaatactcatttttcattttcctcccaaaattaaatagtaacaagttcacagttatatatactggtttttttcaaaaaagtttcattttctcatgagtttatgtataaatatatgaaaaaagtctcattcagcccatttgtgccggcggatattctttatgaccaaatacaatgaaaacaaaaaataaataaacagcccgatcatcaaaccgctcactaacggataatgcttcgcagaatacacaaagaaatccagctgcgatatctgttcgggacttgtgatcgtatccgtattattcaaaagctttgaaaatttagccgtataattccaatcaaacgaatcagaaacaaactcactcccctgataccaattcacagcggcgaggcagaaaaaacaaaaaacagaaaacgcgcattgcacgataagaaaaacatttttcatgtaaagcattcctccgcggttcaatttcatatgccgtcacactatacatgacggcagcagcagaaacttggttttactccgattttataaaaacattattgtatgtacttcacattggttcaatttactggatatccctataaagtataccgtatatcacaaagggtttcagacctaaataaaaaggatgcctcctgaagtccgctgactttcaagaaacatccccgatattttacagagacacttcaacctcttttaagctcggcaaagcatcaatcgcaccgattttggtgcacacgagcgcccccaccttattggcaaatgacacaatatcacgcagcttcgcaaaatcttcggctgccgtctgaatttcatccgtgcgtgccagctgatacagcgccgcgccgacaaacgcgtctcccgctcccgttgagtctattgatgtcaccggaatgctcgggatgatatcaagatccttcccatttgaaagaagggtcccgcttttcccaagtgtcaccgccacaatgccggccccgatctcatgaaggattgcaacaccttctttatgatccttcgcaccgctgatgatctcaagctcctcatcactgactttcacaaaatcacttacggcaattgctttttttgcggtgcttataaactctgaaactcttcccttccataaatcctcgcggtagttaggatcgaaggaaacaaactgtccattgtctttcgcaatcgacatcagccgtaaataggcctcgcaaaacggatctgataacaatgccgtcgctgaaccgaaatgaaggattttcgcatcgtttaccttttccagatcaatatcctccaaagtaaacaaagcatccgctcctctgttaaaaacaaagtcgcgctccccattttgttttaatgaaacaaacgcaagcgttgtaggcgctttctcatccatgacgagcatagaagtatcgacgtgtacggcgtctaaagtctgcttcagaaagtacccaaacggatccttgcctgtttttccgctgaaagccgcgtctccgcccagcttcgcgatggccgctgacacattcgccggtgcgccgcctgcactttttaagaaattgcgtccttccgtcaaatcaacatccacatcggtacaaaagaaatcaattaacaattctccaatacaaataacagattggtttcccacattatcacactcatttgtcagttctcgattatagtttcagtatagtgctttctgtcataaatacaaccgtttacatagaatattttaaattttacgtatacttatcttgcagctctttgctccaggtcagacatcatctgcttatattttttttcagttaaaggataaaaagaaatgagaataatagacagcagaatgaacaatcccggaatgagcgcattcatatttttaatcgcattcaatgacgatgccgtctgctcggtattcgcggcatacccggcgattccgagataaacagccgagaatgacccggctaacgcgactccgagcttattgataaaactcatgctcgaaatcaccacgccatcagcgcggactccggttttccattccgcataatcaacacaatcggcaaccattccccaagcaagggtattcaaaggcgtcgtgaaaaacccagaaacgaaaagccaaaagaaaataagcggaatcgaagaatacgatgtaaactgaaggcctgcgtaagaaataagcgataacgctgccgtgattatcatgacttgttttctgcccctcttctctgaaaagaaaggaataaacagattgctgatcagcgctgccccgaaaaacaacacggttcctaaaaacacaaattccttatggttgacgttatacgtaaaatagtacaccatcgtgctgagtttaatgttaaacccgatcgcaaacgccaaaaatgaagaaaccaaaatgagcaaaggcttgtttcggaacaaaacagataatgtttttttcattccttgtttttttcttttttcaggctgaatccgctcccgtacagtaaagaaactgaacagattcaaagcgatgctcaccgccgcatagataagcgccgtcatctggaatccaaacgcctggtttgtcccgccgatggcgtccgcaagcggtgtcgcacaggagatcgataacagaattccgatataaaccaaaatcatccgggtcgtcgtcagaaccgttcgttcctccacggaattcgtcatccgccccgttaaactgttgaccggaatcgtctgcatgctaaaggacatcccaagcagaatataggtgatgtacgcatagaccatgttccccgtctcgccaaaatttggggtcgtaaaacataagaacgtaaataacgcaaaaggaaacgccacccacagcaaatacggccttgcctttccccatcttgtgctcgtcttgtctaaaatcacgcccataattggatcaaaaatagcgtccagcactcttacaatcagaaacaaagctgctatcaccgcaggcttaatgccgccgatgtctgtatagtagaataataagtatgcgtttacaaattgaaagataatattgtacgacatatcgccgaatccgtatccgatccgttcgatccaggtcaggccgtgatgtttcctttactgccgctgctttttctgtttcaatcatcatatcccaccccaagaatccgttttcatttccagtaaacaagagggagaatgcaaagattctccccgttcactcagcgatttggatacaccatcacttttaagcattcatttttatattgaaatgcccgttccatcgcctcttgcgtctgctccagtgaatattgatccgttacaagatgcttcgtgtccacaatgccggaagcgagaaattcaattcccttcggatacgtattggcataacggaagatcccgtatatatcaatctcgttatctgcaataaacggcacattgagcggaatctcgttctgtgaaggcaaaccgacaatcgccaattttccgccccggcgcacggaagccagtgcggattgcaatgccgccggattccccgctgtttcccaagcagcatcaacgcctctgccatttgtgatcgttttgatttcttcaccggcatcctgttcccggatattaatgacgtgcgtcgctcccattttcttcgcggcatctaatcgcagcggctccaagtcggtcacaatgattgtgcctgccccgtatgctttcgctgccgcaacggccattaacccaacagggcccattcccatgatcgcaatcgttgccccgggctgaagcttcgttctcacggccgcatgaatgccgacagaaaacggttcaatcaaagccgcatcttcataggaaagagaatccggaatcgaaaaaacaaagtcctgacgcattttgatatattggacaaacgcgccgtcaaccggcggtgtcgccaaaaactgcacatccggacaaagattataacgcccttccttgcacgcctcacagcgtccgcacgtgacaccaggttcgacagcaacacggtctcccaccttgaattgatcgacagacgatccgacggcggcaatttctcccgcgcattcatgaccgaggataaatggtttttccaccaaataattgcctattctgccatttgtatagtaatgcagatccgatccgcaaattccgacagccatcacctttatcagcacttcatcatgattgatgtcaggaacgggcaatgtttcgattttgatttctctcgtgttatgcataaccgccgctttcatgttttgaggcactttgtgagtcatttggcaaattcctttctctgctctgaaatgtaagtgcatacatttttgttttctctgttactgccaccattttaacttcttttcaagacgttcaacagcctttcctgctgtataaaaggacagccgcactgtactttttattttttcatatacaaaaaacactgaattgataaaatagtactaataggaggtgcaggctaaatggctgaactagaaaaccggatacaatttgcagaactgctggcacctgccgtcaaatcgctgaaacttcatcctgattacaaagtcaaaaggacaaaaaacataaaagcaggacagacttatatagacaaaattgcactcagattaggcgtttcctctaatacgatcaaaagctggatcggacagatgggcgcaaactatatccccggacgaattgacgacggaaagctgttcggcatgatctggatcattatagaaaagactgacatgggtcctgaatggctgaccggccttctggaaaccaccaccattcccgtcatcaaacccgcattgcccgtttggacggcgtcctgtctaaaaaaagcaaaaatactccggaaagacggatcattcggagcgccgagtgatgaagatgttgaaaaggcagtgaagcggctgtttcaggacagccccggccttgaaacgaatgcgcttacagaacagcctgtgacacataacctgccgtcacgccggacggggaactttatcggccgcggctttgacatggaagcgatccggcaatggatgctgtctccgtcaccggtctgtttaatcaccggctgggccggcatgggaaaaacgacaatcgcccttgaagcggcctattcgtgtatcggcggttcttcagattggacggcattttgcagcatcatctggatcagtgctgactggaaaggattgagcttcagcgattttttaaacacgatcgcctatcacctcggacgcaccgaacaaatcgacaaatcaatcaacgagaaacggttcgtcgtccgcaatgcattagccgctcattcaaacgaaaaacccgtactgctgattattgacagcatcgatatggcggaacgtgacattcacgaatttatcatcagccttccgcaaggtgtaaaagtcctccttacggcgcgggaaaacgtaaaacaaacataccgggacggcctcggagaaatggaggccatccagctgagcggccttgagcaaacggatgcccttgaattttttcagcaagaagtgcaccgctgtctgaaaacatgcaacctcccgcataaacgggagaagctggagcagctgttgaagctatcgcctgaccttaagaatgaattcatctcggcagccgccggcaacccgaaggccatggcactcagtatcgcttacatgtcggacgacgacatccccgctccgcagctcattcaagaacttaaacaagcgggctactcattattggaattgtttgaggttctctttggccgcacatgggacagatgtcatgaagacacacggaaactatggcagacgctttgctttttcgctaagccccctgatgagaaaagtttagcggcagcggccggattagacgcccgccgttttcatttcgctattgaacaaatgcggtcatatgccctgattcagccggaacgaaacgaaggaagaacacagtactcagcgcatcaaaccgttgttgcttacggagaacagcacttatccgaacatcaggaatttgaaaaagaagcccgcagccgctgggcgcattattatattgattatgcggaaacccatataaaacgggaacagcccaattctgtctattggagctatctgctgggacggaatttagagcaaatgaaaaaggaatggccgaatatcctaaaggtcatcgaatggtcaagcgaaaccggacaacatgaaaccctgatcgaactcatcacccgtatcagtcattttctaagcagaatcaacctgcccctgcgaatcgaatacggattaaaatccgccgatgccgcccgtcaatcaggcgaacacacgcgggaagcttacttcaggatcgacacggcaggctgggcgctgatggaagtcaatgatttagacggagctttgcagcaggtagaaaccggcctgaagattctggaacaatcaggagcgccggatcacgacgacttgaaagtatgggggctcgccctgcaatcgaggctgctgttaaaaaccggagacccggaaaaagcggcagcaatgctggacgacataaaagatcagcccgtctcgcccattatccggcacagggttcttctggtccgcggcgacctgagtttcgcccattctcactacgaagaagccatcacattatacgaagcggcaaacacaaccagcgccgcatacggcggcgaaaaaacgatagaagcctatttcaatttgggcatggcttacgtgaagtgtaatcagctcgaaaaagcggaaaaagcctttgaacagatgctctatgacaaacataacgccaatcaagttgagctgatctattactattacggaatggcacagctgttgtaccgtaaaggagagaaaccgaaagcgatcgaatcgaatcagaaggcgattcgtctgattgattcgtgggagcctgggattgggattcggggtgaggtggagcaaatggacattctcatttaaaagacaactacattgcggctagcggtacgagctttgaaaaacactcataaccttgttgtttttaaagataaaaaggtatctttatcagtacagtaaattgattaagataccttgattgaaaaattaatatttcacagaaaacaaatttctaaagttaaactttttaacaagaagaggttaatacttatacagccgtattaatgctgtactgtaatataatgttttagttcacctgaccaatatcttcctccccactcctgtccaacttgcacatcatacttacctgcaggaagatttttcgttgaaaaactcacacgaaaattacgtgaaccaatactatgcaaaatatcttttctggcaattactttacctttattatttaatataattactgaaaagccattatctaaatccctagccaaagtaccagtaaccacaatggaagtagctcttttcgtatatgtattagcatctgttttaaatttgattgtacctttcgaatccatagcaaatgcttctgacccacctgcgaaaatgataactcccaaaagtgctgctgtaaacagtgtcattactaactttttcatctttaaaattccccttttctttttaatattttaaatccacaattataataacatatccccctaaaaaaaagaggtttttccatatccttcttctgagaaatgaataagtatgatagaaatttattaatattaatgcaaatttgagtttcttgtgaaatgaatcttaaaatttgaagtatcatctataaaacctttgccaaggtggccaataaacccatatactcgaataaaaaattacaaagtgttaaacaaatacacttttacaaaaaattttatttttttcaattctagtaggcggatgtgaggagaatttgttcgcgcgcattttatttgcctgctcgaaataacgaatcagttattattttcatctgcagaatcgcgttctattttttcataggatttttcctgaaactttaagtgttttttccaacctcttcttttcttatggttttcccatacatgcagggtgatgacttttcaacggatctttgattttgtgcagttctaaagcagagggtatgatgaacacatttaagaattgatctatatcatcaaagccttttcagtcagttattgtgtatgtgaatttttgtatatcttttcgattgttttcttgtgcatttactcttgttggacattggctttaaaataagtgaagacacgtccggctattatgattgatagcctgaagtacaattttatcaaaaacaccttgtaagtcggttgtattttcataaagttagtgcatttcttctagtctataatgagtggtgcagaatattatatcgttgatattcaatccaagaaaccatatgttacgcccctcccacacaactattcctagaattccaagcgcccaatggatatgggtagaaaacacaatgtgaataacagcatgataagtgacactatccctaaatatctcctcatgtttccccctttctctttccttccatactattaaatttatttttataatagcttatatcttgagaaaacaagactattataatactcttgatctgcatttaaaattggcttagtgttattatttaataaagatctgtgcaatgaaaactctttctgtccgatatacccttaagtattcctaatcaacattatgctggtgagttcaaatatttcttcattcaaactctagttcttctgctctttttcaagatccaaacaattaatgcaataaaaacgatgttaattataaacgcagaaataacataagtttcatctgaaacgccaatatacttccctttcgattctaagagattccttacttgcttactccataaagaaccattcagcgaactatcgtctgctccaaatgtaatttgtgctgtttccttattgttgcttgtaatattaacaccataaaatactgtatacctattgttataaaagataggcatataagaatagtcagaaactaaaggctttacctttttggcaggtaatgatacgtacaaaatcgcagaataattacctatccctgtttcaaattgctctgctttaataaacttcgtgtttgaaggtagatcaatattataaaaatgctcaaaaatttgaatatcttcttccgaaaaatctgttaattggtagtaatgcggatcaataatacatttatgaaaataccatccattaaacaataaaaaacaggcacttattaaaattactaatactgccttatatataatctttaactgtatcacaatgatatgcgcccccctcataatatgcattataacgcttttcccaaaagtaaatcaaaacagcgatttacttttgggaagaattaattattcagattttattttttctttaaggcaatctgcaaatgcttgtgcaattgcttgaccatcctcttgggtataattattaacactaaaatgctgtttaaattccaaacagacaggattgttggtgtttaaatagtactctgcatccttagtaactgcttcaaatgaattattaaatctgtttttgaaaaattgagagtatcttgtactatagccggtagtatagtattcttcaaataccttgtaaactggttgtgaggcaatccctgttcttgtattcatagcaaggttaacagcgtctacatctcctaataaatccggaagtccaaatgtaccaatttgacctcctattaaatctattgcagcatcataagttgttttataattagcattatatttgacagtgtctccccctactgtaattaaatcacctgcccatcctgcaagatcttgtatcattcctacagaactatgaattattgcattaaaagtggccatcatatgtgcgtcatctagtgtcagtttagaaattggatctatcaggattctcttttcttgtcccttcaatacatcatcagctattttaacaaaatctgagtcaataaaatccgctgttaaaatccacaataaaccatcatattcatcttttcttagatactgggcaactaattcatttgcctgttgagtaatattcccgaccggattaggtttatttccttcctttttagtaacataatctactgctgtattatataaaacttttaattgatttaagaacttattatttgtcgtcgaaacataatcgttactattttctttattataaactatagaattaacgcctttatccttgcccgatgagatattattatcaatctctattttcccaagcccatcccctatactccttgttttaatttggtcaaatgcccaatcggtgggaagtgaatagccgcggttaccgctaaatcctgaagacatatcacatacaaaactactgactgagtaacctgctgcggccacgcggctacaaacatttctcgcgccataaataccaatttgataaccactattgagttgggcaaatgtccttttaattgctttaaaataagggagtatacgactggtaacctcaccgtcaacagcgtcgtaatctacagtaaaataaataatagtattttctttaaaaccatatcccttagccgcaccaatagctgctcttgcatcgaataccccttgagtttctgtaaaataagaagcttcagttgattttctctcgtaaattggaaatacgctaagacctgcagcaaatatagtctctaattcaggcaacgtcatctgatgcgatccagtaaggtatctcccaaccgttttatacccgttggatttcaaagttgctgctctggcagcattaattggtgtcgcacaatcacaagctgttcctttcctatcttcgtcacctttgcttactaaaagagatgcccaggtctgcattccagccactccatcggcaggtaatgctgaaaacctttgaaaatcaataagtgctgttctcatattttcatcgaagataccatcaaatcttcctggattacgattattacagtacaaagcatattgtaagagctttacaaaattagcttttgtgctacccattgagattgtcgggcattttgattttgtagcaggtccaaatgttccagttggttctgctattccttcttcgacctggagtgcgtaaattaaagcctcattagtttgtcgggagtatctaccgtcacatggattaaggccagtgaccttataatatttccgattcagctcttgttgaatattacgaattttggcatctcctacatttacaaaagcgtccatatttaatagcgctttaaagattataggagttgcaattccatcttgattagacaaccctgcatcagtttgaaatttttttatagcagcctttgtaccatcaccataggttcctgtaaaaccagttggattatatcccttgcaatacaatgcaccttgaagaatcataatttgatttcttgttttttcattcgaagaatcagatttagttgataatgtaggacattttgccatagtagccggtccaaatgttccagtagttgacgtaattccttcttcaatttgtaatcctgtaatcaaagcctcaatcacaggccaccctgtttttccattttcatcaatttttacataacctggcctgtttaagtaaacaagatttacccattgttgaactttttttaccatttcatccatttttcccactccttattttttgttagtatggtactttcatttaaaggtggcaaacgtatgacaaattaagagtatctactcttacttcaaaagatgtaaagaataaaacctatgaacacaaatccttctacaagatttgtaacaaagtcatataccttgatgcaattgaataaattattctaatttattcgtaatttgagattaatgatagaaataaaaaaaggcctctcacaaattcattgaacttgtgagaagcctcgaacattcataaatagatcaaaggggcatcaaaatgacgtccgttgccgacaaacccttgtaaatcaagggttttttgtcggttttacatcattccgcccatagatcaatcactttcaagaacatacattctcattcatttgggcaattcaatatttgttttttcgctcgattgccctcatatctctcattgatattcatatttggatttataaagtgtgaccaatcgtgtgaccaaaattgaaatcagaaactaaattcgtttatactcccgttaggagttgattcagaatgaccgattttgagcgtaaagtgtatcggattatttttaacatgagccgcttcgggaaaaatccctccatggaacaattgaaaaggaaaacgggaaaagatgagcagacgatccgtgctgctgtgaaaagtttgatgagacaacgcattttgaagtgggataagaaaaaagaaaagtggattttctaactttacattgacaattccataagaaaatagtataataatattaacagagctcacacgcctcttgttcttcggaataatgcggaccacagtgagacttttttttatctaaaggatggtaaattatgtcaagtgtacatacccctaaagtctttaaaacacatgaagaacagcttgaaatacttaaacaacgtggtttaaaagttgatgatgacactgaagcattaaacaccctaaaaaaaatcaactattaccgtttgacaggatatatgttaacgatgaaggtaaacgacgaatttcattcagacgcttcgtttaatgatgcagtacgcttacataattttgatgagaaattaagaaggattttattgagggctattgagtctatagaaatttcatttaaagctcaactggcatatagttttgcagatacttatggtcctttaggataccttttttcagaaaatttcaaccacgatcaaaaaagtaaaaaattccatggagatttcattgaaaaattatctaacacaatcatgaatagcagtgatctttttgttgttcatcatcgtaaacattataatagtaagctgcctatttggggcgcagttgaattacttacgatgggcaatatatcaaaattttataaaaacatgcacagcaaagataagaaagtaatctcaaaaagcttatataatggactttcgcatgccgtgcttagtaattggcttgaggctattactatattaagaaacacatgcgcccactattcaagagtttataataaaaaattctcattttcgattagactatcgccaaagataaaattaaataacagcaagcttgtttcatttatttatattttgaagatattgttgtctaaacaagaatggagtaggtttcttaatagttttttagttttaacagaagagtatgatgatgtaatagaaatgcatcatatgggtttctatgataattggaaagaatatattaattgatcccccaccgaaatgggggattttatttattttaagagtgattcaagttttgctttcgtcttcggcccgaaaatgccatcagcagtcaggccattcatcacaaaaaaccctcctcgtcacgagaagggaatcattcatcatacaaccgatacttcttaacgctctgcctctgacttttttagagcttatacattcaccaagagaataagtaggcattataccagcttttagaacaacaatagattaatagcataataaacaccatcagcaattattttggccgatcctccgccaatcttacccttcaaagccttaaatagcttgtccgaaatcatatgtgcagtaacatcgggaagttcagctatttcatctatcttatctgctatgtagcctgaattctttttaaatgcttttgctgctttagcgtcggcatgttttaatatttggccaaccgctgctccgccatgtctaattcctaaggagactgtatttgcagctaatttgactagatagcctttaatgccggtagtgtggaacactggctcctcactctgttcctcagccaaattgttcaaagtgttagtttgaacattaacactatgtgttgttcctttagtctcagtttgactattaggagttgcggcacttgcaacgcttggtaatagtgttgatactaaaagtaagcttgtgagagaaagaataattacgcttgacataatctttttcattttaccacctccttccaatatagtattatatactaaaatttataatttttgtttaaaattagttaaaaaaggagatttaccatgagaaaaatttacaatcatatgaacgttgaccaaaaaaagactgctattaaattgtttaaagaggatttagaagaactgaagaaggagcagaaacaggaaagtgaaaagggttaccctcgggttgtaagagatgcaattgaggaaactatacaacggtacatacaagatatagaatacctaacaaatgacttaaaacaacatgagcaggcctaatgcctgctcgtgttcatttcaaaagcgcttcgatcttcgctttggtcttcggcccatagatgccgtcagcagttaacccgtacatagattggaatcgtttgaccgcgtttgctgtcttcgcaccatatgcaccatcaattccaaaattctttgcactcttatccgggtagtaatgaagagccgccagcgccgtttgaatctgttttacggcctcccctcgggtcaatgggcttgtgactttaaaagtacccgcaggcaggctgaattttgatttctgagtgtttttaggctttgaggctgttaccttcttcttgccgccgcttttcagctcgttatcgcttttgatataggagacattcacatacccgtggaatgtctggcctttagaattggtgtattcaacatatccccatccgttgacagttgatccaagctgatattttacaaccgtgccattcggcaggttaagcaccatggaagaagaggcgctccgttgtgtacgtaaaacaaggccatcacttgaaactaccgtgtttttgatgaaacggcctttattcgaatcggtgttggtttttgatttgttgttagttggtttgttaattactaccccacctaatcgcgcttttactccattcttgaaatcagtaaacccttgtgatctgcttacccatggggccggacagattttgtgtgtaatgtcatagtgccgcacgatgtcattgatcggatcgagtttatacattttgcacagttcggcacaaacttgttctgcacgggcaatggtatccagatggaaagtgccgttcttttcaatgcaaagctccacgccgatagataagaaattcgcattcggcttcagcgccgcgacaccccggtaaggctgcccgttaacaatctgttggacatcattcgcatgataagccacctcattcaacggaatgatacaaatagcctctgtacgatcgacaaagatatgtgcagaagcaaacgtctgttttttctcaaacagatttctgttctgtgcggggagcgtttgaccaaagtatctataatgattggcagcagacgcgccggggtttgccgtgtaatgtacggccagtttcttcacgccgttgtttttaattcccggccgcgtccatttattaatatcaatatattggtttctgtatgctgacataaaatctctcctattctgtttttggattcaaaaaaagcagccggattaaccagctgcctgatcgtctttttcttttgtctgatcgttgtcgctttcaattacgtgaagccggtcagtgatgacggccgggattttaacgccgatctgtgccaagttttccgtgatggacaggccctcatttgcgatataaaaaagaacggtcccaaaggtcagaacaccgttcaaatttgttatcgtatcaataatgtttgcgacgatgaccaccataaaactgagcatcttccggacatatccaaaccacgcgctgcggctccggagctgcttcattttccacgctttgataattccggtgatgacatccaagatgctgaggatcagaagcaagtcaaggtatttcacctccccgaaaagatatgttcttgcgatctgtaagctttcaaaattcatccacacatgtattccctccattttgatcacctccttcgaggcaaaataaaaacacctattcagttacaggtgctggttcactattattttctttcgctgacagtgcagcacttaattgttcctgaagttcctcgcgcttcttttgagcaaatgtatataaagccttgtattcggcgcgttccttattcttttgatctaattcttcttgcagtgaaatggatttatagatttcaatctgtagctgttcttgaagctgctcttttgtcatttcttgcattccgttcccctccctattcttgatccggatacgcattaccgcgctcttttgctgtaatttcatcatattctgcttgtgtgatgcggcctttctcaacggcttttctcatttcaacggtcaaaacagttccatttttccagcagtcttcaaaaaaaccgaagagaacgcttcgattctccaatgaaatttcctccgcttcttatgattgattcattaagagattgcaaacacgctgaagatcaagagttctagctttcaaattttcctcttcatcagtttgagaaccttcgctttcttctttaatacgttcaatatcttccgttgataagccctcagtccagcagttattttcaaaatctcttttaaccataaaaaactgttcggccggagcttcataaaaaccttcaggtggctcacgatcttcagaattctgataaaacacgccgtttacaaaaccttctttatcaactcctaaaaaagttttcatggcaatcccacctatttatcttttggtctaaaatgaatgttgctaattgacacttcatattctcggccgtcagtcggtccatagaatagctttatatcgccgctaggatacacagtaaaacgttcctttccggttccattccaaacataagcaggaaagatttgctgatactccggtgcaacttcttcaggcagactgcaaattacataatcacgcagctccccagcgcccatttttctcaaaaagccccgcaacattacatcgccgctttcattaattcgatatttaaccggaccaaaagagcctcctttacttgcgaaagggctcataacctgcaagaattcccacccactgtctttatttcttatcacaaatcttgattttttgtgctccaaaaccgcatcatatctatctccatctccgccgatgtaatttacagtatttttcaactgcataacaacctcattgttcagcgaaaaatcaaaatatgtgccagctgaatcatgcgtatcattttgattttgtgaatagattttcagggccgaagtataagtttcttccggaaatgttttgcctccgtctatcgtaattgtgccattctcgattaacacacggtttatgtcatatttaacattcccgcttgtatcttcagcctgccttctttgtgagaatgatgaagctgtcaattctaaaacatcatattttaacccttcatttgctctttttctttgatatattgtacccgcttcaatataggcagtcagtgaatccgagtttgagattggctcaaaccgggctccttttatcaaagaaccttctatcgtgatccccttgatcgtgccggcatttattttatcagcagacaaattggcgatttttgcgtttgtaattgcgccgtcaatgatatgcgcagtgtcaattatggccgttccgagatgcgccttattaattgcggcgttcgcaatagcagcagaccctaccgccgcatctgcaatttttgctgatgttatcgcggccgattgaatattggctgaaccgaccgcaaggtttgcaagatagttattcgtgatgaccccatcaaccagggctacgtcatagggactgtagccatattctttaattaccgctccttttctgacttgaatttttcttacgacataactgcaattactgttatcatccgaaccacggccgcccaaaccaattgtgtaattattaccggtttccggtgccgtgaattgaatattcaccctcttgaattcatctgccgggtaattgcttatgtcagtgagcccgcttgaatccaaggaaataaaagtgctgcctttttttagatgattccaagatatatctgttgtattatttcgtttcacttcaaaagacaatgtatacacgtgatcttttacaagcgacatcgtctgtttgacagagagttgacaaacaccaaaagccttggcgccatcctgagaaattgtcatttcattgaattcttttttgtctatcgtgtacttggtgcctgaataggcataccaccagttgctatccaacaatgaacccggcaaaatattggcatcatcaaagtttctggaaagcttatcagcgtcaacggccagctcggccagtttttcctttgtgatcgctccgaaaacaatgtcatcagtcagaatgcgctgagtggtcgcggaaaactgatccgtgaattcgctcgcagtgccccgtgtgttgattgagcgcaagcgataataccaaacttcatttactcccgtaaaatgctcgtatccgcctgttttgcctctgaaaatacgattctcttttaatggggtgaatccatttacttgtgaagcatatacctcataagctgcgatataactggacggatcataatcccatgtcagggccacattctgaaacattggcttgatcactacattcgacggaacaggcggggctttatcagggaaactgccatccgtaacctctccggcatccggtttgctttcccaagtgccacggttcttttcgatcacactttcaatctgctcaagcctaccgtctttttgtaatgccgataaaaattgcccgatctcaacaacgcaagtattttcaggatcggtaatatcgtattccattgaaataacgcgctgtgatgtctcaattgggatagcgaaatttcgatcaattgcgatcgttgtatctcccaattccacatgttcgtgttcgtgtcccggcacgctctcgagaagttgcacggacagttcgtaattgatttctgtcttacatgcagtcgtaatcaaatgatcatatgtggcctttaagagctcttccggctccgttatgtcttcattattgaactggccttcccgatggatcagctttccatctttaaggcgccccaatcgttctaataaatccggatcgccaacccattcctggcctaaaggcttatcgaccgggtcgccttttgattttttccattccacttcagagaaatcaataaaacgagaatagccgcccgtttcctctccttcctcatccgtagatgctatggatgccccgtaaccccaaagggctgtcaccgggtaactgataacagtccgccggatattcgttgtatccttatcactctcaaagcgcttcccgctgtctttaccgcgacggggaagtatttttatgattcgtttgacgaccttatttccatcaaattctatagtgtcctgaagctctccgccccatatattgatcacgtcagcaatacaatccaacgctgtttttttatagaaggtagtcgaattcactccaagctccgccgttacttccgccacccatcttgaccgagaaagaacgttgtccagtacaaactgagcagttttattggtagggcgaaaatcttttacaaaggtttcggcaagctccatcatggcagcctcacaggtaacctgggtgttaacctctccttcttcacttgtatcatccagttccttgatgacaaacagacgcattacaccgtctttatccttgaataccacttgattttcttcgaataggaagcgtgcatcagggtgggaggcatccgctacaaaagaaaaagaagagcccttgttgagctcttccttgtatttcgcatcccagaacgtacaggtttctcgtccgtggctggacagcactgtcaataatttatcatctggtgaaaggatataaatgtcagccatgaccggacctccttacaaatatgcctcattaaatttgatgctgctcttatgactgaacttgattttaactggcgttctgggcggcagcagaaaccaatctgattgaatttgaagtgctgtcataattaaattaccgctgcaagtgacctttctttttgctgaatcaattacaagagtgtcaccagcgatgaaattgtacagcagcttgatcgttttcgatacagacccatcaccattaagaagagccacttcatatgaagtggctttctcttcaaagacgcattcgattgtcgggtctacggccgcatagcccggattagtgatagtctgaatacctgaattaaattcaaaatccttcgccgggccgtatttttttggatcaggacagataaaagtcaatgttgcagtctgaaagcctccctgttcttcgccttctgaaatgctttcaaagacagcattatagactctgtcaggctcatcgtgaaaaattaacggtttaggttcttcggtgtgcagaataaaagtcagttcctcctgctttttcttcagctcttcttcactgctgaaggcaaaaagaacctccacggttatgactcttacagggattcttgtgtcccgcaggaaaccgccggggcgattcccgatagtggctgtattcacttctcttcctgtcactccccggccgcccgtcgacttcacataaaagaagggtgatatatcaatgccgtcaaacgtgattttccattgattaggcagcagttcctgataattgatcaattaaatctatccctccttgcgtttgaccgtttttgtgcgtatgttacaggctttactactccttgaccgaccttcttgctgtccatctcaacaacaatcattctgtcaggcaattcaaggtttcggatgtccgcgctcaattcttttctaacagtgccaagttcaccgctagaaatggatgtgtcatatgcaaaattcatatcctcttgctgaatagtcatagcttcactgacggctcccatagctttttgaacagtgccgataccattctgaatccccacagcgataccagcaggaaccatgatccccacctgatcccgcatcaatctggatggggagtggattttcaattttttcttaatggttttctcaattgtcgaggcgatggaatttgcttctttcgccagctcgccttgcatattcttcattccagaaataatgccagccattgtatttgaaccgatggcttttccgcttttcttaagagaaccaagctgttttacatccactgtaagctccccaattttgcggagatagtcatttttcaaaagtgccagttctttatttgcggcagatcgtaattcaactattttcttggttgtctcgttcttcagtccggttaattctttttccgcctgagtgctcgccagcttatgcttttcctgccacagcttgacatactcatttaactcggaatctgtcatgcgtgaaatcgcattaatctgatcagctgacccgatacccatttctttcaattcatctgtgaacgccttcggtgcccgacctgctatttttgaaaagtcattgttgaacgttttgatcttgtccagctgctttttaagatttgcagtcagcttggagccgttcacattttgacttgagacatcgtcaaatagaccgatggcgttatagatcgcgtcagttcggtcttgcagctcttttttataggcatcattggccgccttaatatcggcagtcagtttatcattcacacttttgaattttgagagataagtattgtttgcagaaagaatgcccttgttaagtttgtcagccgctttcttttcggcttccttctgctttctggccttatcagccatcgctttttgagtctggtagatttcccgttgaacctttatttgctggtcagaattcagcttgttcttcttcttgattttctcaagcgttttgatataggtattcccgctgatttttcctgtatcgtattttgcctcagctttcttaatctgatctgatactttcttggtatacgccagcttcgccttcgcttccttgcgctgctgctctttcagaagcttcttctgcttatcagaggcgcttttggatgcctgatatatctcgcgttggatttttcggttttgctcgctggtaagcttgttttgcttctgaatcttctgcaatgttttgatatacgtatcggcgcccattttcttggtgtcatacttcacttcagcgttcttaattttattggaaacctttacctcagccgccttctgagccgctttcgctgcttttgccgcggccgcttttactttgccctgcgatttatcaataccagccgccataccggtgccgacgtgatatccgacctggtcacgcattacccttgacggtgaatggattcccagaagctttttcatgccgttaggaattgcgtttgccattgatttaactttgctcgctaatgcacccgccatgccgctgataccatttattaagccttgtatgatgttgcggccaatggacttgaggttgatgcctctaaaaaatttcatgacaccattccaaatgctgacaatgcgttctttcgttgcttggatacggtttacgatttgcgctttcatatagctgaacgctgtagaagctgcgcttttaatgccgttccaaatggacatcactttgcttttcactgtattccagaggcttattactctgtctctcgtcgctacaattctattgacgatttgcgcccgcatgtagttgaaggctgttacagctgcactttttaaagcattccagacagatgtcactttgctttttatcgagttccacaaactgaccattttgtctctggttgcaataatgcgattcacaatttgtgcgcgcatataggtaaaagcagtcactgcagcacttttcagggcattccatatggacgatactttactcttaattgcattccagatgctgatcattttatctctcgtcgcaatgatcctgttaacgatctgcgcccgcatatacgtaaaggctgtgacggccgccgatttaagccccgaccaaattgaggtaatagtgttcttaatgccgttccatactgaagtcgcagtctttttaataccattccagacagaagaggcaaacgattttatagcattccaaactgttgtgaaaatggttttgtacaaattgaattcccatttaaagaaagcagatagcccgttccaaatggttttagctgccgaaacaattccattccaaacagtggagaaaaacgacgttattgcgttccatgttgatgttgccgctgttttaatgccttcccatacagattggagccactgagatatgacgccccaaacttgaagggtgtacttcttgactttatcccaattggcaataatgagaacaactaaggctataaccgccgctgtaatccaaccgataggccccattgcgatgatccatgacgctgccatgcgcgccgcatttgccgctgcttgagctgccaaaatgaccaagcgtttaccaaataagatcatttgtttaatacctgccgccaacattgacacaaatgaactgatttttgccgcagtccacgccgctgccattcgtgttgcttgggctgctgattttgccgctaaaacagttattctggcaatgaaaagccccatctgcttaatgccgtttttcagcattgttatgaaagagctgattttcatcgcagtccatgacgccgccattttaacagcattagctgttgctcttgctgccatcgctgtatacttcgcaatgaattgtcccatagttgctatcgctgattttaattgaccaatcaggccggccagctttatacccgcagctgtggttttgaaggttcgtagatattcagctgcatctttaaaatctttaagaccgttggtaacagcactgactgctactatcgccggaacaatagctcttaaagcaccgattaatgaaatgcccgctgcaatgaacttcccaattgccgggtttgcttccatcgccgcattagtaaatttcaaaaacccgtttacattctccaagatcgttttgccgagtggagccatgccaacaagcaagttgatgatagtcttcgcgatctgccccaatgtgctccatactgtagggccgttagttttgatatagtcaatgaacgattgaaattcttttgttttcgtaacgctgccagcccactcattgaaccgctttgtcatacctaccagcgatgtcatcatgtcttgagacataggagcgaatccagtaaacagcttagtcagaccgcccgaaaagtttctgatgatctgcagcagtttcgggccgttggtttttgtatactccacgaaagcctgaaatttctttgaggagcccaagttcgctgaccacttcacccatgattgggtcattccttcgatggattttgtcatgctctttccggtcggtccgaatgctacgatcagattaaaaactgtccgtaagacattcccggcagatcggccgaatgaagcaaacgcccccggagcttctttgttcagataggaaatgaatctctgcatgtccggagctttaaaagccttgtccatgcttttagccagtcccacgccctcttttgccagtccatcaaacattggaatgagtgagttaagcgcgagtttaaacgtatttagagacataccgaatgtttttaagatcggcttttgaaccatcgtaccgatgtcccgccaattgtctttaaagtcttcgaggttctttaatgcctctctctcttcttttccaagagatttttgcagattattgatctgtttcatgattttagcgcgctctttcgcgcttgttgcattgtccagcttctcctgcagcttggaaaggtcttcggatgctttgaatacaccgcttatcgaagtaatagcaagggcgccgaatgccgccgcgcctgttcccgctgttgcaaatgcactggttaaccccattactccgccggctgccaccccgagcataggacccaatgagccgattaccccgacaatacttgcaagggctggcgagattgcagggagtagggacgttagtgccccggcaattgaatgaccgatgaccgttgaaactgagtttgtgatcttggcaagcctgttcattgacgtttcaaaccgatcaattcgagcttctatactaatccatacttttctcggcaaggacgccagagcagcgcgtgccgttgctacagagcgcataagcgcagctgtgtttccgtttatgaccgtggtaattctgtttggcagtgaagccaaagctgaacggactgccgaaaccccgcgcatgataggcgacgtggccgcattaaaagtggtagttacgttatgagatactgatgctatggctgaccgcgcaacagcgacagcacgccctaaaggagtgggatttccgtctatcgtcgttgtgattctgttcgccaccgccgatagccctgctttagcgcgtgccaatgcggaagataacggccgcacattccccattaattgcgtggtgacagtttggggaatctgtcttaatctttgcttcgcccaattgatggcccgtgttaaagggtctgaatccgcatctaaatcaacccgcgttcgttcatgtcgatgaacaaaattatctatttgttgcgccgcctgccgtactcttgcttgaaagctggcaatttcggcgtcaatctcgacagtgtgatgatcagccatccggcgcattatatcgttgacacgatccatactgcgattaaattttcgtgtctgtgcttcaactatcgctgtcagtctttcgatcattccctcaccccattccttgtccggattttgaaaagtggttgcggattgcatcattaaaccgctgaacccctttggctcgtttgccaagctcgtttacatctgacttgcgccatttgtcgttatcgccagtgatattgcgctccaattgacgtctggccttctttgcatcaaacattttcgtttctttggggcgcttctcattcatggcgtaacggtgaaacatggcgtttcttgccataagctccaattcatctatttttcgcaacttggcccctttgagcagaagcttgtactcgttaggagtccatgacatgattaaatccacatcataaaccccgagccaatgtgcggagttcgtaattatttggtcgtagtcgatcccgttctctctttgtatgcctctttcatcatcttcaagacttccttgccgttctcttcgtcctccaaccgtttcgcttccatttccggtgtttcgttcggagccggtttcttccctttgttcatcttctccatcatcttccaacgctgacggatcacacctttgaaaaaacccgctgagtccagtgtcgtgaatgcttcattgatcatcttgtcaattgcctcgcctgtctcgtcttcatcaatgattttcatgattgcttcttcaatagcctcagttgaaggcttttctttcttcaagtaagcaagtgcgcaatcccaaaaagcagaaaggtaggaagcctcttcattcagcagactcatgtaaatattcattgtgccgcctttgcccttttcgtcctcagtggagtatttttcgtttgccaatctgtcaaaagcaaagtcgcaacgtgatttgtattctttatctccgatagttaagtaagccatttataaaacctccgattatttttgtatgttaaaaaagagcccgggaagcccggaccctatgattccttttctgttcgtatcgtaaaattggccgatcgttccgattccccggccgagttcactgccgacacgttaaaaatgtaggcggtatccggcttcaggttaggattcgacgtgtacgagttcgttgagacagtcgctatttttgcgtaaaatctgtaaatgttgtaagatgtcgcccctttcaccgcatcccatgaaaaactcacctgatttgaagtggcgcttttcgcagttatattgcggggtacgttagggcgtaaccgcttgtgtttgcgtaacaatctcagacattgaggactcgcccgcatcgttcacagcagagacgttgaccgtcagtttcgtgtcggccgcaattcctgtcaaggtgtgggatgtgcctgtgacatttgcgtccagttgcttgctcgctcccctgtataccttatatgaagttgccccatctaccgcatcccatttcacggtcacgctgtcagtcgtagccgtgaacgatagattttggggcgcattagggcgtagtcgtgccgccgaattcctcaaacttagtcgcgccggcagaggattcaatcatcgctaaaatttcatctgatagtggcggcaattcgcctttgaatgttttcccgagcacaggcagagttattgaaacctcaacaaacccatcctgcggctgactgaattccaaactttcaataattgcatgtccaaagacagaatcatgcttatcatttttgtttttgtttttattgactttccagaccttaattgccttttcgttatcataagcactttcaatcgcttcctgccccggatcggtcacagcagcataataagtcagctcaaagctttcattttttgtaccataaccgacaatacggcctgattttgtggactcatccagcgtgtcctgttctttcgtgtgtgacccttctgtttgaaaggcgatgaacagcccgtctgccccttttgcatccatcggctgcacaaaataaatctcatctttaccgtttaataaatctggcatttctttcatcctctcaattgtttattgtgaagcgcattctgagaatgccgtgacgcgtgtacccgtcaatatcggtgatcacctgcatgctgcgcatctcagaacggcataaagaaaagccctctattgttaggggcctgcttgttaacgcttgaagcatgaggctcagaatctccattgcttctttttttccgttgtaacctgaccagcagtgtaaaaccacattgatttcttcaccgctggatgtcttggttttaaatggggatacatcatcatcgcccattgtcacataaggcttttgctgatctttcgggactgcatcaaagacgcccgtgacgcgcccgtccagctcttcgtctgttgataacctcttaaatagagcagcctgcaacggccacagggcagatcgcatgatgacagctcctttctatcacatttgactggcaaaataccgcatgccttcgtccacagctggattccagaacggctgcgcccgcattccccgggtgactacccatctatttagcttggtgtcgtaataaacccacggcgtttgccggccgccgccttcctctgcgtaaatccctgttccgtattccacatatacggcataatcggcaccaacagaaataacggcccgtaagccgccctcttggtagtcgatttcaattgaatttttcaggttccccccgtctattgcggcggtcggagcattcagaacagcatggctgtaaatcagctcggccgtgtctgtgaccagttgcttaatatcatctatgacccggcttctgaattcgctcgtggctctttgcatctgcctgacccatcttccgctcacctcagccattgcccttcagtacccccgttacctgacatttcaaattcataatctcatgcatgccgccctggtcgatcggatctgatttgagagtcagcaccttgttttcgtagatgatccgcattgtcttctcaatatcattgcggtacgggaaatacacattgcaatcaaccggattctgaagctgttgagcctgataatattcccgggacgtaatcccaccgacaaaggcctctgttgtgagataatcagtgaatttttcaacatagcccccgccgccgtccggcacctcttcccaccgctgaaacgttatgacatgcgggaattcttcatagatcatcggaatgcctttctgtatgggtacagattcttcataatgtgttgcgggaattccgtgttatacgaatatgacacatcccccatacttctcccagacagaccagacggcgtcatattgtattcagccgctttcgcaacaaatatttttacaccagcgggcagcgcttttggatcaaaagtatttttgcattcgtctgcggcaacctcaattaaaatagggacaacctcagacaaataagcgtcatgcttatcggttgttatccctatcattcgtttcacttgttggatgtccattggatcaccctttcaatttttcgagaagtgtttctcgtttcatgttgtaataacctgagatccctttatcctttgctacctgcttgagttgctcgacagtcatttcgtcataagacagtttttcttgagctgccttatcgatgtttgcacgccttttcaattcttgttccaagagccaaaaggttgttgctcccatttattcgctgcctccctctgcattggttttagttgcgatttccgacattgcagattcgccgctctcattaacagaagtgacattgattgttaacttagtatcaggcgttagaccgtccgtgctgtattcaggcttggttacattcttatcaagacgtttgtctgctccccgataaacattgtatgaatccgccccagctacggcatcccaattgacagtcacagaattactcgtgcttgtaaaccgtagattttggggcgcattagggcgtaggagtaggctcatctactggaagtgaatcatcaacaataatggacttttgaaggtatgttccaaaacctacatcagccctgttgttaggaatgaactcaatcaagttttgtttctgtaaatttgtatgcgttactgaatgcattgcaattgaagtgaatttccctttagcatccccgagtaattgagctgcatcaagaatcacttcaccgcttaattttgatttagttgctgcttctggtccttcattggaaatgatcttcacaattcggactttctttttgtcataaacacgttcatagttctttgcgcttgccaattctttgaatgtaggcatttcagcagcaacatcagcttcggtccatttgaaaccacgaggatgcataatgaacttcttacgattgatcaaaatgtcctcaccttttagtgagtttcgatctgtttcggttggtgttttcggcatacctggggcataaccaacggcacctccagcaaataggtaagttgtgtactttttcccgtcaccgctcgaaatatctaatacaagatcgccatcattattagtgatgttgctaccaaagacaccatccaacataaggaagatcattttttgaaactgtctttcccaatagtaattgacacgatccccaattgctctcattggatctgatcccgcaagctctcccgctaaatcttctgcgctccaagccttaccatattcgaatacccgagcaacgtctttccctgctttgattttttctggagtcaatgcaaagtttgattgaatcgcctctggatctccttcaagatcgttccaaaaaggcatattgactgtatccccaccactcggaacaattaagcccggtacaggctgaataattccacttcgatataccgctgtttgttcaacagtattgttcattgtgtattggttaaaaatttctgggatgataacatcctgaactctagttactgtcatttaaattctcctttataatccatagattgcaggatttccgcctgcttggataattaattttcttgcttgttctggatcacttttcaaaatgtgaccttgctcagtcaggtttaaatggtcctgactaaatggattcttgcctgttggtgaatgaacacctgaatttgctgtgtcgtgtggctgcctacctgctaaagacggagcgcctttttggtcttcctcaaaaagatagctgtcgctttccctgagagccgttagctgttcgtcaagaccaatcaccttgccgtcagctaatttcaaaccatcaagatttaaattggctttaacagccttgatgttttttgacttcgcatcccgcaatgctgattcaatcgcgaagtcaaaagcctgctgatctaatttttgctgatactcctcagcagtttttttgttgtcttcttgcaattgttcaattgccgcctgaagctcttcgtttcctttagcctgtttctgcaaggcagtcaattgctggtcccgctcgtcaagctggcttttcaagtccttcttctcattgttgactgcatcaaaacgctcctttgggaaccattggccgttactgacaatatcaatcttttgatctccggctttttcgatcacctgagcatataaatcatcaccgagcaattcttttaaactcatttcattctctcctttgatgtttttttgcgtgtccacctcacgcgcaggatttacgtttgtttttgctctaaacctttaaaacgagcagacaaaagagccttttaacgtcatgctcaggacaaaagaaaaaagctgtcacatgagtaaccagctttaaagcttacctattttgttatcgaaaatgtttgttagcttaggagcaacaatgccccatccattaaattgactagagtgattgtctttcgctctgtactctttctgtaattcaaccattttttcagcagtctttgtatcaaatgctttaggagtaaacagtgattgcttcaactcactgataatctcgttgtagctatcagagtcattatattgaattgcactattcaacatttctaggaggtatttaatacgttcgttctctttcatgaatcatttccccctttcctcaatggatttgtaccactcttcataggtttggtatgggatggtctcgccagctccattcccgcgcttacgggcccttcttgtatccggcagcacgccgtttactttgaaagtaatcgtgcaacggcagttaatatcatccttggcattattcatgtgccccggagccggcccgacgccgccgtaaattgatttgaagagcccattgcgctctattgtcttcccgtccagcttcctgtgcccggctcgtgttttaagatcaagggtagcattccacattttttcaagattgctccgttttgaggccttctcagcgctttccatcctcgccgacacttgtaccctatgagcttctgttctcgctacgtcacgggcttttctgcgcgcgaattccgtcgctctttcaatgcggcgggcgatctttgaataatcctcccccgcttgcaggccctgagcgacggaaatttgaatctgtcggacataatcgtctcgatgtcgcctgtatatcgctgacaaagtcaattcggctatagggtttagaatggcctgccgaatgacttcggctgtcgggatgctaaaacccaagtttaccacagattccaattcaaatagataagcagaacgcatgtaattctctaaaaactgcttggctgctaatgcctcaacaattgtcagaatggttttgaaagccttgtgagattcctcggccatcctctccatttccttgttcagacgattgtatttgttggcatcggcaaaagtaagctggccgtccttgctgtacttcgcatacagccgggcaatttgtgcattgatctcctttaagcgagacgcaaaaacgacatcaatcttctgagcatcctcagtgatcatgtcgtccaggtacttatcaatatcattctggttcatcttcatcaccgcccgcgtctgtttccacatccgttaacggcggcatgctgttcctgtattcgatttcttcagattcaattcgcttcatttcagcttctacatcgtcaacccatggatgatgagcgagacgggtttctttgcttaaatcagtgctttgattacccatctgcacctcttcaagttcattggtcatacgtgaacgattgaatgtcatttgtaagagagtgtgatcgtattccccttggccggtcatccgcaaatattcagtaaaaaaccaaaagaaggcatgcaaagccggacggaatttcctctcagcttcatttgccttcagatcaagtaaagaatataggtttttaattgcaacgttcgtcggtgaatttcccactttgtcaggattattgttaactccctgcccgaaccggtatatattttcttcaagtcggtcaaggtgggtgttcgcgctgtcaatcggtacttcagcagttttcatatccattccgccatccgaaccgacttcaacggccttgtaataacgtagatttgtcatgaactcgctcaaattttgaccgccgaagtttttaaggatgtaaatgaagtcttgcatttcatcaaaagtatttgcgttatttgaaatgttgctgttgtactgatcaattaaatccttgtaaaaaacaagatcgctgacgccttcttcattgttcttgaattcgattaaggggacttttccccatccatacccggcattccctaaataaaaatgactctccgggtttcgttcgtagtcaaaatcaagaacgagagcgccatcgtgcatgacgtagtagaatgtctgctcatccgtatacaattcgaccttacgagtgtattcatcatcaaagtttttcacatcataatacctgatagcatacaggagcttccgctttttcgtcgtatcgtataccgcaatgacttcttcagctggaatccggataaaatcaaatttcccgtcttcatcaacaaacgggtggagccattcactgcccttattactggcgttttttaaaagctcattcattacgtcatcaaaatcttcgtttacaaagtcattgaccaactccaagaactttgaatcttcagcattaaaagtgattggtttcccgaccaggtattgcactttctgttggaccagcagcttgtgccagttatgagaaatacggttattgggtttttccttatctattttgcgtacgccatcctcatagaaatagcgcagtcttttttttatgtcggcctgattcatgtaatatgcgacgccctcaagcattcggtcacgatctaattcgtgtttatcaatcatcttttgaataaccgtagtgttcggcagagtatctgatgtttctgcactgtcctgaatgattttcaacagctcttctgtgtgtgttggtgttatcggatacaataggagtcagctcctttctttttatcttgtcataacccgtacgcccggccgcttcatatcccgttcaaaagcataacgagtggcatctatagtgtggttgtcagcgtcctcaagccgcgccttcggattgccgtctctatcagtctgatagtcgatattctcgaattctcgggcgatattaggtgttctcaacggatcaatgataatggcgtctaaatcatcaagccattcttcgccatattgaaccgagtcaggtccttttttcgcgcctgtaatgcgccggatgccatggtctattttcaattcatcaatacttttaggttcggcactgtcagcagtaatttcttgactctcatatccttttgacctgatccattttgccagctctctgttggaaaccttttgatcataaagctcatcaatcgcatagatactgttccgcttcttgtcatagtgccacctgacataagcgagaggatcaggaccatatccaaagtcaacgccctgccggatgttgtcgaaggagcgaaccatttcatcagtaatgcagccgttctcgattttcaaattatcaaacggcacaacaccactccctaacgcttcgccgagatattcccatctgtactttaatgggttccgttccttaacgatctcagcctcttccttaaaggcttttgagatataaggattttcgagatatgttgaatgatggatatatgtgttctttggtacgaatgaagattcgtattttttgttaacccacgattgctttcttttcggcggattgtatgaatagtaaaaagcataaaaaagaccgtccgggagttcagcccgcaggacggaattttcgatcattgaaatttcttcttcaagtttaaattcggcaagctcttcgacccacaggaaggcaaccggaaattttgcgatcttgagtgatttgatttttgccggatcgtctgcacccctgaagatgatgctgtttcccctgggtttgtacgttagcctcatcggcgatttattgacatgccagtattcacctacgcccagcagatcaattgcctctttaagctgctcgaaaaccgattcccctaatgtgttggcgactttccgaaccacaagtgtactaaccgggtatttcatcatgtcgttgactattcgggtaccaatatgcgtcgatttcgaagagccacggcctccctttaagacataccgaagatatttgtgactgttggctgccgcccagaacgaacggaatttcggcgttacgatgtccgatattcgcttaaccttcgtcaacgtcttcacttcctatatcatcaatgatcgtcacgccgctgtcttttggagcgtctttctcgacttcgttccgtgttttctcgatatttaagcgcatttgttccaatttaaggcgccgttcatcttgctcatgcgccagctggtcaaactgcttgatcagactccggagctcccccattgcccgagattgagcgtttaagagagtcgcatgacgatcccaagcgaactgtatttcaagttcctcttctacaatgtttttctcatatgttagattgccatcttcgtcctcatcttgatgataggcgtattttgcctttttcagctcttttgccgtatcatctttattctgtacaaacataatgcgttgcgcccgtagaatggctgcatattgtatttgaatctgatcccatatcatatcagcaggggaacgttcctgaatctcttccatgatttcaagcgtttcttctggaagatactttgagaagaatccatgtgatacagcattttgatttcttgccggagccgccccgccgctatttcctaatgcgtttttgttgccgggttgcccgcctatttttgtgtgcacacttttttcagggggtgcaccctttttcctttcccaaccatgccgctgcttccacgatttaatggtgttcaccgacaccccgtatttctcggcaaggtccttgtatttcatgcctttgacgtaatccttatacgcctgaatgtgcttttcagccatctacattcaccgccgcccccttctgattcgtgtttgttttggaaaaagatattccctctaaaccgacaccgcactcagaccgttaaccgccaattgtttttctgagatttaccggaatcagtttacagagaacataaaaaagcacccgtaaggatgctttaaaattacattacaaattcgacagagtataattcatcataacgtctaactatattcccgttaagtgtgagagttgcgttgttctttttcccattcacaatcgttttcacaaaatctccttcacttccatccaactctgattcaaacagcataccgtccttaaatttaaacaatacttttaatttcatggtttcacctcccaccttattatcggttaaggagtgtgataaaggaactatttgcaaaatttgtcgaacgaaagcacccttcataaataggtggcaaccgtaagacgaaaaaacacccttttgacagggtgctcatttccgcctatgtttttggaaatccaaaatatcctctttcagaaaaagcctgtcccggggcatttctttcatcggctccagttccccggtctttactaactggttcagatactgacgggtgaaccccaaaatctcaagcgcttcacttgtattgagtatctcttcattcaggaatttcttgatggcgtcacgctctttaggcttgtacatttttgaatcatccttttttctcgcgatatttcaagtaaagggaaaatgctttctcgatgatcgaaacaacaaataaaatgatcaggctaatgtcgagagccgttttcaatggtcccgctgccacatcctgacggaaaaacaacatatacgccaaggcgagaagaacaacaatatcggtggtggactgtacacttttcatttttttgaaagtggctggctttcaagtatttttctttagtcgccgcatttgctatacttggagcaagggagaagcgctaccttctccctcggctcaaaatcatttgcgctttcttggacgtctgcgttttttgattttgggcttttttgttttaagcttttccctgatgatgaggactttttcaacaactgtgagagttgtgaggataatccccagtaccaatgcgatttcagccactttctttccctcctttctatactctaattatacctcatttgtttactcacgtcaagtaatttaatgggcttttttcattatttctccaataaaaaagagcctattcacgctaaacagaataggctgtgatctgctctatttttcattttcaggcgggaacgttcaatgttcttttgtacggttccttttttaatccccaataactgcgctatctcttcgaatgacatgttttgcacagcgtgcatcatgaatatgtctttttctctttcggtaagcacggatagggcatcagcgattctttccttatcccaatcacttacctctccctcagcctcttgaacgattgagtattcttccggcagcgcatcaattaagcgcggatcagcaagaatcgtcctttgatatgcgtctcttctgtcagcacctcggcgggcgcccggctgtcttccgttctgcagccattcaagagtgaattcaatatcgctgatcatgctactgataatctttttgtcgttgatctgttcagccgtcagattgacttcggccgtatctttgtagagccggtacatttttcttgtttctcttaaagcccgtttgtattcaatgattaaatcttgcattctgattcctccccttatttgcgcttaaatgcgccgcccttgcctcgtttaagtctttgcatgtcttgtcccatcatttgccgccaaaagcgttcagatcgctcctgcgcgtttttattgggctttttctttttctgcttcatgtcatccctccgctcaaataaaaaacggacaccaatcagagcacagtgattctgtgcaatgatcagtgtccgcaggctttccgtcttggacttattcagttagattcgttcttattcttctctacatacttatcaatatcttgaaaaaacgccgcggccgtgaatgcgatgattgcgcctattaacgtgatgtttgctttcatgtccggcctgtattcgtactggaaataaaaccagaaacctaaccccatcagcataaaaactattctcagcgccatcgaatcccccttatttgatttgaaatttagctgattctaatgttccgatgtagttccgcttgccggaatcagagtagcagtcaagctggatgacataggttccctttccggtcttattccggatcgttttcacgttgaatgacttcagaggcgttgccgttttgaagctgccccgctgtattaaattcgtatcagtcagcccaccgccactgcgcttcttgtatacgccggccgtataataaagtgtgcttgatccttttttctcggctttccagtccaccgttgaggcgccggccgtgtatgtcgcggcatctgtaaacacccggccgctgtacccggattcattttgccagccggaccatgcggcggaagcagacggcgcaacggccgcggctcccgtaaataatgctgctgatagaatgattgatttgaatatttttttcatgattgttcatccccttagaatttttgagtcattcaacaatttcctaaattttttatgattttctttagaacttcgatatgcgttttgttaaattcgaagatgtgtgcctctgttgacgaatcatacaagtcaactaaatgaccatcggtacatatctctaaacgcttagaatgcctatcacttatttctaaactgttactatccgaaagctctttactcattccgcgccctcctattcctatgatcttagttttgtcttatttatcatgattgtcatgcaccgcagtatgaaaaagggaagtctgatctagcccggtgcgataaagaaatccagcgtagcattttgtcttaaatccgactttctgaagcaaccaacaaggaaaagaaatagttgacgataggccaatcaataaaattaacaaaatgcctgttttccaatctagtttgaatccccacataaaataaatccttcccttcatccttatctcccatcactctccacgccctcctgatttaaaatgatctctttcagatcattcaattcaacgacaaaatcactgaatgcatcgtgcaacggattttccttttgtgatacggcgtctgctcttctctcatatacacttatcagcctttcaacttcttctaatggcgttttcagcctttcgaaattctcttgcactaccgcttcaactaatgaatagcgagaaatattgtttaaaggggcatatttcatattgccagtgtctccccatcttccgtgaaaataaatgatttcagaaataatcacatctttatttcctatccctaacaatgtacagaatgcattgtactgctcatctgtcaatttaagcttcacgccacgccctccttagtaatttctccaccaaactataaacccccaaaacaggagcaggaatactatgactccaatcattccgcaccctccttcttttttaacggataccatccacgaaccaagtacccactgataactgcggtaactgacacacaatttaatctcaaactctgattgtcgaaataatacgccagaactattcctatggaatcggcaacggccgacattatgagaatcatcaacactctaaatgcaaatttcactccgcgccctccaataactcaggatcttggtaaatgtcgccgatgactttatttgtcgccgtctcagaaaacaacggtcggcactcttcttttttctcattgatgatgcaccatgatccgtcaatcattttcacttcgccgatgaacggttccggcccaaacaaaccgccgggcgctgtttcctcctgtttaacgatatcgcccgcataaattcgcttcagtctcgagtgtgtttgaaactgatcagttccattcatgagaacggattttccgtctccgctgtgtgcgatcacaccataacctcctaaccatacagaccatccgaaaacttttccttcaattgaacccaattcaccgatggaaaggcatatgccttcatcaccgcaataacacatctgctcgccatcccatactctgtatgcggccttcataggagcgaaccgtccatgataaggactttaatgtccggatcgttgaaagtccctgaaatataggtgtaagacatcagctctccatcttcaccctttacttgcgaatacataatgagcgcatagtctcgttccacttctcggatttcatcgtcttgaaaattttcgtaatcgtccgtgtcagaaatatactcgttgtaaatcctttcagcatccgcctcgtctttcgctttgataagcgcgtaatatggatcatggatttcatagaatttcattgttcttcccccttcaattgtttggatagtcgctcattttggtgtgacgagtgaataaatatcatttgttccatcaatgatgtcaatttcatgaattccgcctttatatgcccctgctgctatgattcggaatgcaaacagcgttaataactcctggctttcagctttacaccctgcgaatttcgggttagactcgttccggaaaccgatacgcttgttatcctcaacaatcgcatcccagacatcacccctaaactgaatgacatccacctcgaaacctcgattacgaatgctattgattactttgattgccgccgattggattttttgaatatccatcaatacccctcctgctgccgctggtgattgacggcgtttttctccatgtaagccgcttcgatttgctcccatttaaatccgagccgctcaccgagaatgaagaagcttacacaaaggtcgagaaactgcacttcttttccattcatcacctgtaaacggtaagcagtagacatcaaagaagaaaaaagccgctcagtgttaaaaccaatggtagaactcaagtaacttaaatggatggaggatattatctttttgctatttaagcccaacttgttcccaatgctcaagataaaatgcaggcagtccacgtattcctcaagtaatggattcgattcacctatctttcctgagccgttgcagtctcggcattcggaatatggttcagttgcatgtccttcctcgaggtattgcaaattaatatcgtggttttcatcgccagtgccatcacacgtcggacataaacgctctattttcgtccgcggctcccggtcattgctccaatgcttaaagccgcgccattcattcgcacactcggcaagctccacctgtagagcaagaatgaggttcggcagcaagtcctgcccctcaagccccttttctttgatgatccgatcatcaagcactttttgcatttcaaacattttttgtagattcatgattcaactttctcccttctccgtttacgcggaatgcctatttttcttgcatgatagaaataagtatcaatacattcgaaaccgaaatgccgtgcaatttggaagtgggtccaattctggttacgaagctccgtccattcttccagagtaaacaggcgatacggtttctggattactatcccgttagcctttttccagacggaaagagtggatggagagcaatggagttcctctctcgctatttccgtatcagacataccgcgttcatgaagctctcgatattgctcctctgtgaagccgatgtcatcaagtaaagtcacactatttcctcctcggcgcccatgccgcgcccacagtgcgggcaacaggcatctgcgcggatttctaaatcaagtttttataatcgcagtccgggcaatggtattcgatcatgaccgggcctccaaactgaacaatgattgctgaaagtaactttgttcagcagcaaccgggttgatccataacacttcttggcgtttggccccggcttccgctgatacttctcgtatttctcttttccaatgcctgagtcgttcatcgtatattggatgtgcataccctgagagaagaacaggaccagggtgttcatccagcgtctcaagcagttcaacatgatcttctattgtcatttcgtgtttgtaatgccgctttgtccgcgtttcgatgatgtaaggcgggtccgcgtaaacaagaaccccttttcgcttatacctttcaagcagctggactgcgggctgatgttcaatctgagcctctttcagtcgcttggctactaacaatacctttgcaggcagtttaccccactcttttgctgtgtcaggcccgttactactgatcaagctccgccagcctgtccggtcacttgttttcgctcctatggcctgccagcaacgaatgagaaaacgtcgagcgtcctctatttcatcgcctgattcagaatcataggaggcgtaatattcctctctggataacggcgtccattcaattaatctcgcaagctcttccggatgatcccgaatgactttgaaaagattgaccacgctgctatccagatcattgattgtttcgatgatcgagggctgtttattaaaaaacaatgctccggatccaaagaaaggttcaacgtatgttttatgctcgggcatatggctgatgatccagtctgtcatagaccatttactgcccggatagtgtaaaatccgcggaaatcccatcccttaacccccgatcaaattcggcagcacagagatagtgaagaagatgagccccacgcatgccccgaccagccagatacttgttttatcccgtttagcgataatggtatcgccgatcattttgagatcgtcagaacgatcgacaagcgtcgggatgtagtccgggtgaacctttaaaagctcggccgcctgctcgacggtcattgcttcgtccttcgtggccttcacgttccgttgcagttctacttgtaatggcatcattccgcagccccctccagtgcctgagttgcaatatgttcagctatttcaagagaatcaactttaggatttccggctattatatcgagagattttcgatagtgttctttttccttagtaagccgctgaatctcttcccgcgcctgccgaaactgattgaccgtgacttcctgctggcgttggtgttcctcaatgattgcctgctgcttaacagacagttcagttctatcaatcagaaaatcaacatgttctttagtcatccagtattgatctgttgacttagcattttcatagccttttaattttgaaatacgcgctttaatttcctgtaatttatccatgcccgttcctcccccgcaggggaaacccctgctatttgaatttgtggccgatctcgtaatcacaacgagccaggccgccttttattgtttgaatgattgttttaccgtgttccggggcgtccattaaatgagcagtcccttcagtgccatctaaaacgatgatgcgaactttccccggctcgatgctttgctgaatagttgtttcatgattttttatttctgttggcttgttcactctggccgccccctgtgctatgatagaagtaccagttcatatcaaaggcactgaggcgcagcttcggtgcttttttacgttttacgacggcagccgcatcgttaagccggcagatggctttaattcctcacggtagatgattggatgcttttcgacgtatgccgccaactgctccgccgtcattttccactccttaactggaccaggcttgtatggatcgattttttcttgcatagcgataacctcctgaattgattttgggaatttctgaacctccaagctttttgcaatccgctcccatgcggctggcgcatcgtttgtaatcggaacagagcatcatgcaggccatgagcttatcttcttcctgcacccacaacggccgatcgtctacgattaccacgtttcgcagtggtcttccccgcctttcttttgagttttttcagctcgtccagctcaatgaagccgagtgccttatccagcgccagcaccttgagtggcgtctcgtaaagccgctcatacagcttgcgtttgatggcaaattcctttgtttccacgcccttgatatcaatgatctcgatactgccgtcaaggttatgaacctcaaagtctgcaatatattcaatcttccgaaaagtcttgccgttctttttgaatgcctcttgaagcaggaaccgcggctgcagcttaaaatctttgatctgcttgctcatcttgagccatttcagctgttcatagtatttggcttcagcccggctatcgaacgtgatgccgtccacctgtgtttttctggctccgtatttatttgctggcatgtgaggcctccaaaagctctggatcttcataaatgtttccgatgacttcaaattcatcaaaccattcaacaaacgaatgaatattaaagttacggttagttttcacggctcctacgccattaatgaacaattcttcaaaatccttaatatcgaaaacaaacgataagtcatatttgaccgttcccttatgaacctttcctgatttatgttttgctataaagccgtctccctcataaatctcccggccgtttttgtccttcaatccggtgtattgcattaaaggtgatacatttgaaaactcgtttttgaaataacaagctaactcctcttcgtcattattgagaagttcatcccagtcaagcattcgcggaaattcttgaccgtctcttttctctgtatgataagcccgaaacttaatctctctcattcttccgcctccatatctctgactatttccttatcggcccgtttccgcttgccgtcgttacctcccgtcaatttgttcccagtgctgaatctgcttttccttgtatggcgccgtgaagatgatggccggaagcagaataaccgctttaagcactgtgcatcagctccatttgtttgattttttcctcaagcacccggatcgccggggtaaggtcctggccggccgattgctcggcgggcccgaacagatacatgccgccggttgctgtgaagttcgctttttcggtcattcccaatctcctaacctatgatttaattgcatccggtcgcccttaatgatcaccgtgtaatctctgcacatttgatgaatccgggagcccagcgcctcgtcaatatccaaaatttcgcccgtatcaagctcggaagagattagcagaggcttatgattcaggtaccgatagttcacaaccgattgaatttgttccacttgccaatccgtcgcccgcggctcccccttcactggcttgaataagtcatcaatgaacaggacatcggctttccgcatggcgtcgagctttgtttccaactggtcaaagtcatttcgcagatcgcccattccctcaacgtacgggaaatacatgcagtaaattgattttttcttgatcagattgttcatgatcgccgttaacaggtgcgtttttccactgcccggctgcccgagcaaagcgatactgtttgaacgttttcccatgatgttgagaaaatccttatagtattccactgcgcactcataagcgtccttgatcatgtccggcttgccgtctgtaatgaaattaccaaataaaagcatttcaaattcctccgtaatgccgctggccttcataagccgcgcgatcttttttcgttttacacactcgcattgctttgaaaatgtggttttccattcccgggccttatccggcaagcatactttccccgcaagataatcctcttctcttaccatttgatcgggggccaggctttccattgtcttatgctcttttctcagctgacgctctgtgtcttggtgaatccggtaaacgataatgcccttatccttgcagtcagagcactcgtattcagccttttcttctgaggcggcctgtcccactgaagatgctgctgaccgatcccggagcttggttagaatggccttcattgccgcgtccatatcttgcgttttgcgagcttccatactgctgtttctcctttcgtctctggctgaatgggtttgagaggattgcttcaatgtaattcagattgacgttgttgcccttgcttctgaaagcctgtttcattgcttccatgactttctcttcgccgtaatcatccaccatatacccgagccgctgaacctccattgtgccaatggtgcgggctgttttgttttcgaatagttcaaatgcgtttttcattttttcgtcaacctcctgctgtgcttttggcgctgattcttttggcgatgctgcgtctggtatatctgctttaccgttctctgtttcctcattacgcactggattttcaaaagagatcagtttgtatttcccggcctttctcccctgcggctcatattctattcgtttgagctcgattagaatttttcgatgctttattagtgttgcttctgtgatttctattttggcttgaagagtggtatttgaagtggtgaaccactcccgccacccggttttattgttgatgtgcatcagatggaaccataacgcttgtgttgttgcagacaacggattcgtttctaaccaattcatgaagccgttcatttctttcaggtagttcatggctcacctacttcctttcacacagtgctgtcatgccgctgatgcggactaaacgtaagccaggttcatttgttctgagatagccttcgacataatcacggaacagctgggcgcgatttggtgccccttccgtcatccacttgtaacagaaagggatgccaaccttaatcaaatggcaggtcattttcactaatatcaacaggcttaccatcaaaaggatcagcattctgcgcgcttggcttttcttccggtgcttcagcatcaataatctctggctctgccattgcgtcagtaatgtcaatccgctcacgttcctcgttatcctcgatgactgccttttgcatttcaacggagagaatcccccatttactaagcatggatttaagaacggttttaagcgccattgcgtcccagtccttgccccagccaaagtccgacttactaaacttctttttgtgtttctctacttgcgtctttgtccaatacactgttttccggaaaccgtttaaaagctcaaagtaagcagcgtagccaataaccgcatctgattcccgtttttcaaaatcaatctctatttcctcggttagtgggttccacttttgcaattctcctttatggacaggtatgcaattgatagatttatattggcctgtccgcaaagcaagctgaatgtatcctttgtaaccaagctgaaattgcgcgcgccctttatacggaacgatccaggcataacccaagttcttatccactggcagatcaagcgttgccgccaccatagccgatgaaattacactcataggttctgctttttgaagagtattttcactgttgtacagacttaaaattgatgctgtgaattgagacgcccttttccccagaacttcttcaaaccggttcatgactgccggagaagaaagcaggcctttcatcgttgttccctgcggctgccctggcgcgttattctgtttttgaatgttatttttaagtgattcatttgtagccatatttagctaacctccttaattccaaagcgtctgtattgaacttcttttgtgactttctcatatacatctggaaactgctctttcagtttattagtgtcgatccggttagttataaccggtttccagctggtctgatagtttccaatgaatccgtattctgcttccttcatttcgtgcttgatttggttttctaattctttcgcctgcaattgcaattcagcgatgctttcctttaattgcaaatactgctttatccgttcacggtttaccgctgtaagatcaataaccttgttgctttccgtttccgcatacctttttttcagatattcttctgctgcgcttgatccgtccaatgcgggagcaaccccacccaacaccgcagtattccaaaactcgacttcggcagtgaatatcatttcgattaattcatcatcccgctcaatttctttccagacgaatttattgccgccgatcagaacagcaaagtatgcttttttatactcgggaccaagcactccaagatagtgctggacctgaacaatatagtcagcagggatctcgtcattttcccattctttcaagttgtattccgatgtggtcttacattccagaatggccttttctccaacgatcattcggtcaatattcgccaaaatgaaatcatgttcaggatgcttcagcatggaccttttacgcctaacttttttcccgctccgcacttcaaattcttttgcgacaatgtcctcaaggattgagccgaagtaagccgcctcactggctgactcactgaccgggacttgtcccgttttgtccagccataattcaaatgcggttctccatttgtttaaccccaagattacggaggcatctgaaccgccgatgcccttccgtcgctcaagaagccattcgtcccgactcatgtccgctgtcgaagcgaaaacctctgcttgcattaaataatccctgcctttcttttgtatgcttccgcaccaagccgctgccattctcggtatgcgtccattgacgggaaggaaaatacgggtttgcctttactgaacatgattgagccgccgacttctctcaggcgctgttgatcgtccgcccggtcactgaaagctgctgttattcgtttagccatgtataaaacctccattgttttttatggggcgttttggtataataggaatacaatcaattaccaaaacgccttacctagtccactctgccaagtgggcttttttattgcgctgaatgaaacctaaatccgagttgttcctttaaatagcgtttaagattgtcttgtaaaatcatctcgccgctgtcgattacataattatctgctgacgttacttcatccccgaaaaagtccttttttgtttccggttcagtcgccttgtcatgccagttgttcaagaccattggattttcaatattcattgtgaacacctacttacaacactcaggtgaatccctcgggccgccatatttaaaacggtttgatgtaagcgccctttattcgccagtcggctgatatcctctgtaagaaccttgatgctccctgcaagactgatagcttcttcataatcgccatcccgtaacgcctccgatagcatgatagagagctcttccgccgactcgatttttctttttgctgaatctgcatccgatttaagaaactgattgatcttcataccagcaccgcctgcctttcttctgttttcgccattgcaacctgactcattagcgctttccgtgtccacctttcagccagttccttcatgttcagtccatgactacgggccagcgaatatatcagcgttttgtttgccggaattagatcaaaaatctgcttaatatcggccatgggcagttcttcaggttgtcggcctggcctatcgtttgccagccagcgcgctaaatgccttgttgcttgcaatgcttcttcaagctgatgaatcatattgattaccgccgcgcttgcgctctcgttaagtgctggatcaattggtgccgccgtcgtcgggtgaagtttgaaaaggtaatgtaccagatcaatatgttcgtacgcctcgcacgcctcaaaccacttgatgcataattccggagtaagcttactgaatccattttcaacgtccgaaacataccgctgatctttcccccctatcaaattaccaatctgatactgtgcaagtcctgccgctttgcggacactacgcatgatccggggtagattatgcaaattgtatgggttgttctccatatgtttgcctcctgatatatccagttgttcactggtaaaatttaattaatgaagggacaagcttgtccttttctcgaacattaatctccccaaatttgtggagattgtttcaagctgtttctgatgaaatgaatttattcacaaaataaatctgaccttttcccgtaacctttggcgttcgggtagttctaattgaaccatcagggttattcattgttctcttcttaatttcaaagagacccaaatccatacttcgctgtgttggtagattgaaagactcgcctgtcttacgaattaaataaccattatcacggagccattgaaataacttgttaggtccaatctttacgccgttctgttgaatgattttcgctaactcgccaacaagcacagatgattcagatgcttccacggcttcggcaaaaagagcttttggcttcatagattcaatttgcttattttgctcctttagtgcgtgaagagttgttttgaaaaataatttggtattttcgtctgcgttggacaaatacgtctgaatgaactgttcatcatttgcgacatatcccccagtttttctgattgtgggtataacttcaaaggctaaccaatcttgaaattgttcggcaatttgattagatgctctaaaagccagcttgtacaccaatggttcaggaataaaatcacctttctctacttctggaaagttatccggaaggtaagtattcacacggctccatcggattgttacgttgccacttttggcaacggtagtgaggcctaaattccgagcaacttgctcggcatcaaaaaggatttgatcattctcaattttggctgcaacttcgaaaatttcatttttgaatgtttgtaaattattcatgcagaagctcctttctgatagtatgcggtgttctcagcaacccaacgcgtgttgctctcaatccatttaaaaagcaaagtcgtagggacttttttgccacattcttcgttaaccggaaaatccggacgggccatcagttccgccattttagtgggaccgcaccgcagcacctccatcgcttcagttctcgtcaagatgtgaggaagctggttcaaagagctgagccgctctaccagcatgtctgttgctctatcagcaattttggcagcgatctgttcaatgaatttctcatcgtattgcatagtgaacatataaaaaacctcctttacaatgagctttataatctctcactttcatgtggtaaaatatgcatggaaggtggtgagatttaatggcttctactaaggtttacgcttgcctttgtggtgaatgggttgacttgactagtgatccggactgcaaaataggtgaatctatgtcttctccatacatatggtgggaagaaggtgcttcaatttggagccctaattctaaagaagagcacacgatgtatcagcaagattacgttaatatttattacaaaaatgctgaatatcgcattcacccaatgtttatccaaatcaagtattcatcctaaattcacgtttaaggttagcttctaacagttctgggtcgtcaaactgcaatttggcggctttagaactgaacagtacgtccacatgttgtttaacacggaaccactcggattgagtcataccattcaataaatttttaatttgttccagctttttttgatccataattttgacctcctatgctgtaggggaatccttttttcatccctagcatttttttagaacctctgataagcacgattcgtgaagttgttctgtaaaaaaaatttcttgaacggacttgttgtagtatttagcaattttcatcttaatttcatcacgaggtatacgtttacctgactcatacatcgctaaagcactctcgcttatctccagagcctcagcgatgtgagatcgcggttttttatttctgagctcttggagtttagctccaatgatctgtttattcatttagcaccatcctttacatttcgtgttgttctgaaatctatattaaaccgcacattacgtaaagtcaagacgttttgtgaagttttttctaaaaagtcacgaatcgtgatattatactaaataggtgatgtatatgagatttggcgaccaattaagacaattaagaaagcaaagaaagctttcacaaaagagtttagggcaaaaattcggcttggctgaaagcactataagcatgtatgaaaggaacgaaagagaacccgattatgctactcttgttaagtttgcagatttttttgatgtttccacggattttctgctgagaggagaagattattatagagataaggcccgagaactccgcaaacaaaatgatgtccgatttgccgctgtcgatggtcgggagttctctgatagtgaaaaagaggagattcttgctgacgcattaaggcgcattgacggaatcgaaaaaattattgaagagagattcaaaaagaagaatgaagataagaattaattatttattattgttttgtttagtttaaataatgctgaacagatcgctttaatttttaaagtttagtgttaagttgactgatgttcaactttaatttttaaagcgaagcttgtaatgaaaccttcagttattttcctttcaaatgaacttagcttttttagcacacctcatgaaattattagcaaaattggtaattaccccttgaattttcaacaattatagtcgattatatataggtattctattatatgaactgggggaatcaggttgaaaaagtggttagttttattcatgtctctgggcttggctctagctttagcagcatgcgggtcgacagacgatgtctctactggcagcagtgattcaaaagacaaaaaaactgaagagaagaaagacgacagctccaaaaagattgacgctagtaagcaatctacagaagcactaggaatgaaaattaacctgggcgacgtcaagattatgaaagataaaataaatgttgggcttaacattgaaaacactacaggaaaagtccttactttttatcccgatcaaggtaatgcagtcattggcagcatgcaattatcggcaaatatgttcctgactgacggagaagtcggcggagacgttcaaggcggagtgaaacaggaaggtgtacttgagttttcagcgccggacggaaaagaaattgatgttgataaagtcaaagaaatcaaattaaatttcggtgatgtggtcacagatgacttcatgaaaactaaagcagtaacaatcactgtaccagttaagtaagggagagttaacaatgaaaagaacaacagaatttgttttaggcttattgggcggaattttcggttttattggagcaattatggcattaattatcggtggactcgatgcctcttttaattcaagtggcacaagcgatataattggtttgggctggggcgctgttttcttatcaatcttaggcatcgttgcttcagttgtagttaagaagaaacctaaagtcggtggagtattacttctcatttcaggaatcggtggattgatttgtatatccctcttctatttactacctgctgttcttcttattatccctggtatcatgggacttgtcagaaaagataaaacagtaacgacagcagcttaaagaaaggcccttgatagggcttttcttttccagtaaacacagaacaaacgttcttaataattctactataatctatttatggacacatttaccggtgtaaaatggtacatttttcccctataattacatacaagcaaacatatttaccacattttaagcattgacaaggtaatgagggggtcaattacagcatggggtatacacaaagagtcacttagaggattggatcgaaagtttcctcagggaacacaaaataacaacgcctttagaacttaaacttgttaaattatgcaggaagctcaatgtatttgtactttttgatgatcgggaaagttatatgttagatattgggggtgttcatatcgtaggcataaacaaccggttaagctatcaacagcaacgatcggatttagctcatgagttatggcacatcttattagaaggcggcgacaacgagcttatgccgccccactggaaacagtatcaagaatcaaaagcaggttatttttcatatcacttttgtgtcccaacattcatgctgcgacagatgaacttacctgcagatgaggaagccgctgcacggttggtatcagatacttttaaggtaacttttgattttgcaaaaaagagactaagaatttactttaataaattaaactatcgttaaggaggattaaaatggttgtctttaaaaaggagaaatcaaagcgttcatctaaaggatatacttggtattttgtgatggaaaacggccgcgatccaagaacaggaaaacgcagacaaataaaaagacgtggtttcctatcaaaagcatcagccgaagccgcttatcttgaattgaaaacgaagctcctttcagggattgatgtcgggaaagagaacattctttttcaggaaatcaaagacctatggtacaaggaatacaagcataccgtcaaagtcagtaccctgcgagcacgaaaaagtgaaatagagagtttagaagaatacttcggaaagatgaaaattaaagacataaccaggggtgtttatcagaagtttttagattatctgagagaggaaaattattccttcaatacaataagtggtatccacactacagcaagtatgatcttcaaatacgcgaggcaggaggacatcataagtaaaagcccgacggaatttgtaaaacctcagcgtccaaagctcacagtagaagatattgaatcacaagaagaagccgaaaactttcttgaaggggaagaacttgtagagtttttagaccttacagagaaacacggcctttttctcgactttgaatatttctgcatggctgcatttacaggcactcgttccggggagcgattggccggcaaatggagagacttaactttagagggagacgacctcaaaacatttcgagttaccaaaacgctttattgcccatcaaacaaagcatctgactatgaactgctgccaccgaaaacgccagctgctgttcgggatgttcctttgtcagactttctagcatctctgttgaaaaggctaaagctcaaacaagctaaaatagcatacgcgaatggacgcacattcagtgatgatgattttatattcgctcgtcctgacggccaccctgagaacattaaaaagatggataccagaatgagaaggattttaaaacgaatggacataaacaaacatattacccaacatacttttaggcatacattcacttcgcttgctgctgaggcagatgtacctttggaagagatacaaaaaatactaggccatcaaaatgatgacataacgaaaaaagtctatttacacactactagaaaaaccaaagaaagaacttcgcaaaaattcaattcattcataggtgacctctcaatgaaaatacagttatcatgactcctatgtgaccaaaatgtgaccaatttcataaaacaaaaagaaaaaccccttgaaatcaaggggtttcggcattctttacatcattccgcccataccgcccatgccgcccatgtcaggcattcctgcgccgccggcattttcttctggtttgtcagcaacaaccgcttcagttgttaatagcattgctgctacagaagctgcgttttgaagtgcagaacgtgtaacttttgtcgggtcaacgattcctttttcgatcatgtttacccattcgccagttgcagcgttgaagcctacgccgatttcttcgtttttcaggcgctcaacgatgacagatccttcaagaccagcgttgtgcgcgatttgacggatcggctcttcaagcgcgcgaagcacgatgttgatacctgtttgcgcatcgccttcagcttcaactgcagcgactttgttatatacgttgacaagcgctgtaccaccgccggatacgatgccttcttcaacagctgcgcgagttgagttgagggcgtcttcgatgcgaagtttacgctctttcagctcagtttcagtcgcagcgccgactttgatgacagctacgccgccagcaagtttcgcaagacgctcttgtaatttttctctgtcgaattcagaagttgtttcttccacttgagcacggatttggttgacgcgtgcagcaattttttcagtatcgccggcgccttctacgattgttgtgttttctttcgttaccacaactttagaagcgcgtcccaattgtccgatttcagtagatttcaggtcaagacctaaatcttctgtgatgacttctccgccagtaagaacagagatgtcttcaagcattgctttacgacggtcaccgaagccaggagctttaacggcaacagcgttgaatgtgccgcgaagtttgttgacaacgagtgtagcaagagcttcaccttcaacatcttcagcgatcagaagcaatggtttgccttgctgtacaacttgctcaagcacaggaaggatttcttgaatgtttgtgatttttttgtctgtgattaagatgtaaggattatcaagaaccgcttccatcttatcagagtcagtcaccatgtaaggagacgcatatccgcggtcgaattgcataccttcaaccacttcaagctcagttgtgaagcctttagactcttcgattgtgataacgccgtcgtttcctacgcgctccattgcttcagcgataaggcttccgacttcctcatcagcagcagagattgcagcaacctgagcgatagactctttgccttcgatcggcttagaaatttcttttaagttttcgattgccacggttacggcttgttccatacctttacgcacgccgacaggattagctcccgcagttacgtttttaaggccttcgcggatcatagcctgtgcaagcacagtcgcagtcgtcgtaccgtcaccggcaacgtcgtttgttttgctggctacttcagctacaagcttcgcacccatgttttcaaacgcatcttcaagttcaatttcttttgcgattgtcacaccgtcatttgtaattaacggagaaccgaattttttctccagaaccacgttgcgtccttttggccctaaagttacttttacagcgtcagcaagcgcatcgacaccgcgaagcatagcgcggcgtgcttcttcactaaacttaatatcttttgccatgttaacgaaacctcctcgaatttttaaaaatatttatttgcttagccgataacagctaaaatgtcgctttcacgtaagattaagtattcagcaccttcgtatttcacttcagtaccggcgtattttgagaagataatgcggtcgccctcttttacttctaaagcaacgcgctctccgctttccaacacgcgacctgaaccagctgccacgattttgccttcttgcggcttttcttttgcagaatccggtaatacgattccgctggcagttttttcttcagattctacgagttcaatgacaacgcgatcacctaatggctttaacaatgtaataacctcctcaatagtatgaatatgtaattttagcactcagctctaaagagtgctaacacatttattataataaagaatctcacttccaatttcaagtcataagaataaaaaattttcacgcttacatgattctctcttacaccgattttctccttttttcacgtcaagttcacttgtgttacaataagaacaaataagttgattttataggataaaggagtacatatcatttgagaaaacagtattggtatatcattttgacatatgttatcatgcagctttccgcattgatcggcattcctttaatgtacagattcggctatgcgggcgggcagcctacgaatgcgaatctcaccatggctcaggggatttattccgtcgtaagcttttttatctgcctgattatcgttctcctgattttgagaaccgcgccgaagcagacattaagaaacgggaagaaagcatccgccggcatgtccattctttgggcggtcgcgggaatatggctcgctttattttctcagggaattgccgggatgattgagcagtatgtctttcacgtgaacagcggttcggaaaacacgaaagccattctcaacattatcaaagccatgccgcttatgattatcgtttcttctatcgtcggtccgattcttgaagaaatcattttccggaagatcatcttcggtgtattatatgaaaaaacgaatttctttatcgccggactgatcagttccgtcattttcggcattgtgcaccaggacctcacacacctgctgctttacacggccatgggctttacctttgcgttcttgtatgtgcagacgaaacggattattgtgccgatattcgcccatgtcatgatgaataccattgtcgtggtcatgcagctcggccccgcccaaaaatatattgaacagcatagtgagcaaatgcaattaattattggaggattgtttgtatgaggaacccaatgacttggggcttgatttatttcgcagtcggctgtatctttacgtatttggccgcaagctcgccgggaagcatgtggtctttttattccatactgctgatggttttcgccgcttataatatcagcatctcgtttaaaatgttcgctttctcatttaaagtgaagaaaaatcaaaaataaaagaaaagccatttctcatcattgagaaatggctttttttatgctgatacatcctggtcagattcgctgctgccggtctgctttttccgatatgcggcttttgaaataagaatactgatctcgtataaaatgcaaagcggaatcgtaatcatcatgtgagacagcagctcaggcggcgcaatcatcgcggcgatcacaagcagcacaaaatacgcgtacttcctgattttcgataaaaacatcggcgttacaacaccgagcctcgtcaaaaacatgatcagcaccggcatctgaaacagcagcccgaacggaattgtcagctgcagcagaaaatgaaagtactcgctgattccgatcacctgattgacatccaagtcattcgaaacccgcttcataaaatcaacgaccagcggaaataaaatataataagaaaatgacacaccgctgacaaacagcacgattgaaatcggaatatagctgagtgttactttgcgttccttctcatacagccccggactgacaaacgcccaaatctgatatagaataatcggcgaagtcaaaatgatgccgataataaacgcgaactgcaaaaagataaacagcggatccgtcaggttaaaagcattaagggtgagctcttttacttcatcggctttttgaagatacacaatgataggttttgccagaaaaaagccggcaataaagaaaaccgcaaaggataacgccacaatcagcaatcgtttccgaagttcggcaatatgctccacaagcgtcatttgattcactctcatacgtgtcatcctatcttactgttcttctttctttttttcctcttcttcaccggctaatcctttagtagcgttcttaaattctcgaagcgtgtcccccgcagcttttcctaattcgggaagcttcttcggaccgaaaataatcaccgccaccacaccgataaccgccaggcttccaggaccgatcatgtgcagctcctcctttcgttattcaatttcttccaaaacagaataatgctttaagaaataaaccaatgattgaagctctacagctaaatctatatgatgaattcgaatgtgatccggcacattcaaacgggccggcgtaaagttaaggattcccttgattccgagcgccacgagccggtcggtgattgactgagcggcaaccgccggaacggtgagaatcgccacgggttcatccttaatgtgaagctctaaatcatcaagatcaaagacaggcacaccgcctacctcagttcctattttactctgattcacatcaaaagccatagatatttttgtgttattattttttgtgaaattatagtgaagaaacgctgtccctaaattcccgacaccgatcaaaatgacatttgtcgtttcatcctgatccagtgtttttctgaaaaatgacagcaggtaatccacattatagccgtatccttttttgccgagcgccccgaaataggaaaaatcccggcggatcgtggccgaatcgacttttaccgcatcgctcagttcagctgaggaaacacgctgctttcctgacgcgtgtaaattctttaaaaagcgataataaagcggcagccgttttgccgtcgcctgcggaatttttgattgatccttgttcatgattggtcctccactttatactcagatgcatctcttttaaaatcaccgtttttgccgcccgttttttccatgaggcaggtcgggccgatgaccattcctttatccagcgccttgcacatgtcataaacggtcaatgcgcagactgaagcggaagttagcgcttccatttccacacctgtactccctttcgtttttacgcttgcctgtatatgaagaacggcttcggaatccttttcctcccagccgaatgaaatgtcgacgctgcttaaagaaagcgggtggcacatcgggataatcgctgacgtctgctttgcagccatgattccggccacctgtgcgacagccagcacgtctccttttccgatctcccggtttttgattctgctgtacacgtcatgcttcatgtgtacgctcgatatcgcagcggcagtacggactgttgaagatttatcgcttatatccaccatgcgggcacggccttcttcattaaaatgagaaaatccattcatatttaaactctccttacttctgatcatacactattttctccctgatgtcttatcctataatgttccaattctgatgtattgtttgctgacagcaggttgataagctacacttaacttattataacagaggtgaaataatatgatgatcttacaaattaatcagctatccaaatcttttggcgctgatcctattttaaacaatataaagcttgaagtcagatcccgggatcgcatcgccattgtaggcagaaacggagccggcaaatcaactctccttaaaattatcgcaggtcacctttcatatgaaaagggtgaattaatcaaaccgaaagaattaacgatgggataccttgcccagcacacaggcatggaatctcagcttaccataaaagaagaattgctgagtgtttttgatttcctgaaagcaatggaaaaagaaatgcgctctattgaagaaaagatggccactgccgccccggcggagcttgagacgctgatgaaaacctatgacaggcttcagcaggacttcaagaataaaggcggctatcaatatgaagcggatgtccggtctgtccttcacggcctcggcttcggcaaatttgacgattccgtgaaagtgcaaagcctgagcggcggtcagaaaacaaggcttgctctcggaaagctccttttgacccagcctgatctgcttattttggatgaaccgacgaaccatctcgacatcgacacgctcacatggcttgagcattatttacagggatattctggcgccatcctgatcgtctcccacgacagatactttcttgataaagtcgtcagccaagtgtacgaggtctcacggacagaaagcaaaaaatacctcggcaactacagcgcctatttagaacaaaaagccgagcagtacgagaaagacctgaagctgtatgaaaaacagcaggacgaaatcgccaagcttcaagattttgtcgaccgcaatctggccagagcatcaacaacgaaaagagcccagagcagacgaaaacagcttgaacggatggatgtcatggcaaagccgctcggtgatgaaaaatcagcagccttccgttttgaaattacaaaacagagcggcaacgacgtgcttcgcgtacaggatgtctccatcagctacgacggccagcctccgcttttgaaaaacctgaccttcggcgttacaagaggcgaaagcgccgcccttgtcggacccaacggaatcggcaagtcaaccttgctgaaaaccattatgaacacgctcagtccggaatccgggtcgatctcgtacggttccaatgtcacaatcggctattacgatcaggagcaggctgaactgacctcgtccaaacgcgtcttggacgagctgtgggatgaatatccggacatgccggaaaaagagatcaggacatgcctcggcaattttctgttcagcggggacgatgtcttaaaaccggtccgttctttaagcggcggtgagaaagcaagagtcgcgcttgccaagctgatgcttcaaaaagcaaactttctcatccttgatgaaccgacaaaccaccttgacctcgacagtaaagaagtgctggaaaacgccctgatcgactatccgggcacactgttatttgtatcgcatgaccgctactttattaacaggatcgccacaagggtgcttgagctgtctcaagaccatgcagaagaatatttgggagactatgactattacaccgagaaaaaagcccagcagctcgaactggaagaaatgaagcggcaggaaaaggagcaagcacagcctgccggcaaggtcaaacaggacacgaaaagaacatatgaagaagaaaaagaatggaagaagaaagagcggcagcgcctgagacgcattgaagaaatcgaagcggccgtctcatccgctgaagagaaaatcagcgccaatgaggagctgctgtgcgaccctgaggtgtatcaggatcatgaaaaagtacagaccattcacgctgagaacgaagcactgaatcaagagctggaacaattattagcggaatgggaagaactctcatcagaagaatagtaaaagtcaagcacctctttaaggggtgcttttttatccacatctttcttccttgtcagccatttaagtaagcgctttatacacactatccacaaaattttctgactttatccactttactcacaactcgcagccccttatccagtatggatttctgaatatatacacaatcctgtggatatgtttgaattatctgttaataagtcaaaaaaagcctcacgttttacaacgtgagacgatcaaaagacattaattccaaaccaggctgtccgttcatatcgtatgaaccccgaatccccttttcaaaagcaacagttccggcagccgcaatcatcgctgcattgtccgtgcataaagaaagcggcgggatgataagttcaggatctcccgcatggctgaattcctgctgcagcgcggctctcaagcccttgttcgcggctacgccccctgcaagcagcacttgtttaactccgtattctttggcggccttagaggtttttgccgtcagtacatcaatgacactctgctgaaagctcgcggcaagatcctccggaggaatcacctcatttttttgcgaggcgttatgaagcgtgttaatcacggctgactttaagccgctgaagctgaaattgtaagatccttcttccagccacgcgcgcggaagcggaatggagtccgttcccacagcagccagcttatcaatctgcggccctcccggataaggaagccccatcgttcttgccactttgtcgtatgcttcacctgctgcatcgtccagcgtttcaccgataacatcgaaggaaccgtgctctttcatatagaccaattccgtatgtccgcccgacacaaccaaagcaagcgccgggaactgaagctctcctatcagcctgtttgcataaatatggccggcaatatgatgaacgccgactaacggaatttgatgggcgaagcttaacgcctttgccgcattgacgccgattaaaagagccccgacaagacccggtccttccgttacggcaatcgcgtcaaggtcatctaagcccaactccgcttgtaaaagagcttcctcaatcacaagggtaatctgttccacatgatgtctggacgcaatttcaggtacgaccccgccgaaccgtttatggctttcaatttgagaagcgacaacgtttgaaatgatgtctttcccgtttttcacgactgaagccgctgtttcatcacagcttgtttcgattcctaatacatatatatcttgtttttcactcatgtaatgtcacccacattaataacgcatcttccccgttatctgtatagtattgttttctgattcctccggcctgaagaccgaattttttatataaggattgggcgggatgatttgagaccctgacttcgagagagagccttcttgcctttttttctctgcacaattctatcgcagagccaaacagcgcttctcccaatgattggccccggtattccggcttaatggctatgttcgtaatctgcgcgtcatctataataatccagattccgcaataacctgccagacagccgtccttttcaatgacaaggtagtgcgcatacggattttccaaaagctcatgataaaatgaatccttcgtccacggagaagtgaaggatgctgtttcaatttcataaatttgatcaatatcttccggccgcatgcttcgaatcgccgttttcgttttcatccccatcaccctatttttgagattccatccatttcgcttcagcctctgccagacgcaaataatccggaacaaggctgtggacatccgcttcttctttttccaagcctaaaaacgccagctctgacggccgcggattatgctgcgcagccgttcctatcactgcttgagaagccaattcatgtttaatggtttcttcatgaatggctgtatcgtgccctaaaaataaaaccggagacgctttttctctcagcatgccaagccaatcagtcaaaagcacattctggtcaggaagaacggattgtaatcggccgtcctgatattcataaagacccgtatacacttgtccgcgacgggcgtcaaataacgggcagatcagcccttgaaagtgccgtccgttagccgccagcacctccaggctcgatacagcggaaatcggaagcttcagcgaccaggccaatgtcttcgccagcgtcacaccgattctgacacctgtgtacgatcccggccctttcgccactactattttcgtaaggtcctgcggtgttaaaccgcaatccgccagcaatgaattgacagcaggcatcgcccgcacggaatgattcttttttaaatatgtaatatactccgccatcaccgttttttcacgaacgagcgcggcacccagcgtgtaatttgacgtatcaattgccagtattgtcatgtttacttatctcctcacaaagcgtttcataccgtgttccgcaagccgtaaaggtaatgtccctttcctcatcaccggctctcttgatgacgatctgcagccgttcgacaggcagctgctcctgaattaaatgagcccattcaattaaacagacgccttgtccctcaaagtattcttcaagtcccaagtcttcgctttcatcctccatgcgataaacatccatatgatatagaggaagcgaaccgtcatggtattcttttataattgtgaaagtcgggctgtttaccactctcgtgatccccagaccttcggcaaaaccctttgtaaaagtcgtttttcccgcgcctaagtcgccttccagtgtcagaatatctcccggctttgccaaagaagcggcaagcttggcaacggcttttgtttcttcggggtttttcgttctccattgtaatgtcttcaaagtgagtcacccgtcttatttaaaatgattgtatccttttttctcaaggacgatttgtctctgatcattggctgtcataagaacacttgcttccttccgttcagaaactgctccaatcttagcaatcggaatgcctgattgagtgcagtaatcaagcaaagaagtccactcttgctgagataccgttccaaccaattcaaaatcttcaccgccgaataacacccatttctcccactgaggatccgcctcaggtaaatccggatgcacgggcagaagctgttcttcaatttctatcgtaactgaacttgactcagctatttcatgcagctcactggccaatccgtcactgatatcattcagagccgctcgctgaagctgggagcaaaagcggccgacctggaccctcggaacgggccgtttatgttttttgataaaataatcactcgtgtgaaaagcagagggaggtgtttctcccaataaaagagacagcccagctgcggacgaaccgatatctcccgtaacaaaaacaacatccccgggccttgccgagcttcgcagacaagcgcgatccttttcgacttctccgatgacagtaacagtaataacggcttgaccggaagcggagacggtatctcctccgatcaaatccatccggtatagtttcgccagttccgccatcccttcatacattgcctggacatcagctttctgccagcaagaaggaaccgcaagagataccagataaaacttcggaatgcctcccatcgccgccacatcactaatgttaacagcaagcgccttataaccgatatcttgaggagaggaatactctgatttaaaatggacatcctccaccatcgtatcaaggcagacaatttgctgcatatgagatgatgctgtataaactgcaccatcatcaccgatccctacattgacggaaggatgataatgcgtatgcggcgtaatactgtgaatcaaatcaaactcgtccatgtttctcccgtctccctttctgacgctcttgtgaacagctctttctagtgtatcggattatgtttcaatatccaagactttaacgatataaaagaaagcttggttagataccaagctgccagcatttaaaagaaaacacaaaaaaaacgaaaacatgatcgtttcgtttacaatgagttgctctatccagctgagctactgggacaagattttgctttatgtatcagcgacaagatttattatatacaggttcatatcataagtcaatattttttcagaaactttttatggggaagaaagaaatcttccccatcacatgttaaaagctgattgtattctcaagtccttcaattcctgacctgtttcgtcgtaaaaagccatggcgccttcactttctgtgagagtaagaatggcatagcttttcacattgcggactctcggaaggcggatgctccccgggttaatcaaaagcttgccccgaagcacttcacttccggcaatatgcgagtggccgaagcagacaatatccgctccaagctcttccgcccggtaaaaaacagttaaaagtgactgtttaatgccgtgaagatgtccgtgaacggccaggattttctttgaaccggcatccagcaggagttcgtcctgaaatccgcccccaaagtcgcagttgcctttcaccgtatgatacggtgtgagcgcaggatgtgcggcgtcaagctctgaatcaccgcaatgaatcatcagatccacttcgtcttcgtgccgcttcgcgatcgtttccagttcgtcttcaaggccgtgactgtcacttatcatcagcactttcattgcattacgctcccccttacgcatcaagcagctttgacagtttcttgagcgcttcagccctgtggctgattttgtttttctcagcgcttgtcagctgggccatggttttatctttatcctttacaataaaaatgggatcatagccgaacccgttatctccctcgggttcttctgcaatatatccttcaacatggccttcgaccgttttggtttcctgccccggcatgctgacggcaagggcgcagcggaaacgggccgtacgctgctctttttcgatgccttttaattctgacagcaccttgtccatattcgctttatcatcttttgcttcgcctgcataacgggctgaataaacgcccggtctgcctcccaggttgtccactgataaaccggagtcgtccgcaatgaccattttgtttacggcttttgccaccgcttccgcttttaaaatggcgttttcttcaaaggtatgtccggtttcttcaatttcttccgtaaatccgatttccgccaaagaagagacactgtagcctttcggttcgagtatttctttaaattctttcacttttcccggattgtgtgtcgcaataatggcttctttcacgctgatcaggcctctctttctttatttcagttcaggcaatgtatctccaagcacttctttttgtttttgaataagcgtctggattcctttttcggcaaggcttaacagtccgtttaaatcttcacgggagaatgtggcttcttcgcccgtcccttgaagctccacaaaacgtccgcttcccgtcatgatgatattcatatcgacttcagccgctgagtcctcttcataattcagatccaaaagaaggccttcttctttatccatcccgacagaaatggccgcgagatagtctgtcacaggagaggttttgataacgccgctttttacgagtttgccggccgcaatggccattgccaagaaggcgccggtaatggaagccgttcttgttccgccgtccgcttgaatgacgtcacagtcgatccagatcgtccgttcgccgagcttctccaaatcaacgacggcccggagcgcgcgcccgatcagacgctggatttccatcgttcttccggaaacctttccttttgaagattctcttatcgttctttgattcgtggcgcggggaagcatgctgtattccgctgtgatccagccttttcctccgccgcgtaaaaatggcggcacccggtcttccactgatgcattacagatgacctttgtatttcccgctgtaattaacacagagccctccgggtgagtgataaaatccaaatcaaatgtgataggtcgcagctcatcgtgctgtcttccgtcgtgtctcatattttacctccgattatatgtacataaaccttttgttccggattgtgaataaagaaagaggcagccggaacgctaacctcttttttactagtatatcaaaaatcgcaaattaaaaactacccgtattcacttgggacggcctcgaaacaggttttgaaagggattctcctttttcattcaccagttctgattttccgtttacttttatagaaacactttttatcgacggctgttctgttaatgtgaggacgatgctatccagcacgcccgatgataccatttttgttttttcatcggcgcttccgtaaatagagctgttaaaatcaagtgtaacctggccgtcttttactttcggcttactgaggagcttaacatcgttattaaagtccgtcaaaagcccgcttgctttgcccggtccgtcggcgagctgctcaacggctgcggtgatgtcgtttgtttctgaattgtcaatccgctttgtgacaggcacgtagtattcactggtctctgtttccgccagataatacacagtcagcggatgggtgtctgtcagatcattcactccggcggtttcaatattaattccgtcttttctgcttaagtcgcccgtaatcggcgtgccgcccacaggcatttctttcagttcatgcccgttgattctgattttgactttatctattgagctgaattgggtaagcgtccatgtaatcgattgcaggattttttgttcgtcttcttttttgtagtttttaaattccttcgaaaaatcagcgacggcggtaccgtcttttttaatgtcaacatttaccgtcgtatccgcagggagcaccgctctgaagccattcggcaggatttctgacacaggccctccctgaaccaaatactcaagggcctgctttgcggttccctcactgttcggaagaggcagtgtctgtgctgcgacatagccgtttttatcaatcagatacagctctctcatgactgtattggccggctgatcggctttagatgtgccgtttttttctgactgcgttgattttgcctgaattcccgcttcatcttttacatatgaaatgtcttgaggcgggtcaatttccccggctgttttatcggattgaaacaaaccgcatcctgataatacaaaagccgaagtaagacatgttgcagcaatgactgcaggtccttttttcagcatacttttccctcctaaggctgtttgtactatgatgtatacgagccctgtgcgggaaatagaccgggatgcgcaaaaaaacccgccgtaaacagcgggttttttgatttattttctgatcggctcttgaagggagatgcactcgacatggccgatttcatgaccgaaccagtcttcggcaatttttgcgaagccgttccgctctcccgttgttagaaactgatgctccggtgcatgtttcgattggtttaacaagcctttataagacaaaatcgtgctcacttctctcgctgtctcgtctccggaggaaatgattttcacatgctttcccatataatcttgaatcggatcttttaaaatcggataatgcgtgcaccctaaaatcaaggtgtcaattgctgtaccttttaaaggctcaagcgatgcttcgaccgcttccgccgccgattcctgaagaaaccgtccgctttccacaaacggcaccagcagcgggcaagctgtgttctcgacttgaaggtctgcatttaatccgagcagcgcctgctcatacgctcggcttttaatggtatttatcgtgccgatgacgccgatatgctgatttttcgtgaccttgatcgctgttctcgcacccggctgaatgacgccgacaaccggaatatccgttttgcgctgaatatcctccaaggcaatggccgtggccgtattacaagcaatcacgagcattttgatatggtggttttccagcaggtaatcggtcatttcccacgtgtattgaagaacttcttcttcaggacgcgggccgtacgggcagcgttttgtatctcccacatagatgatattttccttcggtagctgtctcatgatttccttggcaacggttaacccgccaaccccggaatcaatgactcctatcggctgttccaacaaaatcgcctcattttcttttcatttcatgctgcagtttcaataatgacttttcgaagagggctgtttcttcttcggaaaatgtctcaaacatatcccgcaaataagcctgtcttttcaaaatcacttcctggataatgcgctctccttcagcgagaagatgaattctgacgacacgtctgtcagccgggtcttttacccgctcgacaagcttatttttttccatgcggtctatcagatccgtcgtcgtgctgcaagccaaatacattttgcctgataattcgcctattgtcatatcccccaattcataaagccattgaagccccacgaattgcggcggtgtaattgaatattggttaaggatctctcttcctttttgtttaatgatcgcagcgatatggcggagtgatttttcgatatccgcaacatgctctacagattttgatgtcatttgtccatccctcactcaaggatctttctgggctatgcgctccgtgtctattttccttctttttttaagaaaatgcaagactgacggagaaaaagggaaagccgggattttcaccgcatgcccattttcctgggcgccaacacaaataaccggctccttctcgtaaagaaggaaaaccggcaagaatcagagctctagctcacccattctaagaagctcgacaacagcttgcgaacgccctttcacacctaacttctgcatggcatttgaaatgtgattccgtacagttttttcactgataaatagctcgcttgcaatttcctttgttgtcttgtcttgaacgagcaattcgaatacttctctttctcttttggtcagcagcggctttgattgaaaatctttctccttcaagtattgtaaccctccttgctaaggtgagagcgaatctgaaacgaatgggtttatatagtcaagatatcatatgtaaagggcgcttcggaggtgacgtcacttagagaaatagttatccgctcaggagagcagaatgcctttctcccgctccgtccagctgaccgctttgccgcttgtctttgacacttgaaccataacgacggaaccggtaaaacacggcaggcctgactcattttctccaaggtaatgaagggtgacggacgcatttccgacagagcttgctttgacatgaatccgcaggttttcatacggcatcacctgacgcatatagtcgcactgctggcttgcgacgaccgtcatcgtttccgagttttgcgctgatatgccccgctgcttaaaataagcgatccgggcttcttcaaaatagatgaaagggattacattattcatatggccgaacatatccgtttctgaaaaccgaaccgtcacttcagtgaagaaagaaaacgactgtctccactcttcaaacgggatgtcaatatattgcggttgtttcatcaccttcagctccttataaaaaaacctctcccgtgcggaagaggctctttttttctttcttatactctgtcgcttccgaagaaatttcggaatgcttgtaaattcgtatctctgttcaaagcagcgattgaagtcgtgagcggaatgcctttcgggcaggattgaacacagttttgtgaattcccgcaatctccgagaccgccgtctgtcattaaagcttctaaacgttctgacttgttcatcgcgcccgtcggatgggcgttaaacagacgcacttgcgacatcggggcaggccccatgaattttgatttgctgttgacattcgggcaggcttcgaggcagacgccgcatgtcatgcatttagacaattcatatgcccactggcggcgtttttccggcattctcggtcccggtcccaaatcgtaagtcccgtcaatcggcacccatgctttcacttttttcagtgaatcaaacattctgctgcggtcaacctgaaggtcacggacaaccgggaatgttttcatcggtttcagacggatcggctgttccagcttatcaaccagcgccgtacatgactggcgcggtcttccgttgatgaccatggagcaggcgccgcatacttcctcaagacagttcatgtcccatgcaaccggcgtcgttttctccccttttgcattaacgggatttctgcggatttccatcagggcagaaatcacattcagattcggacggtaattgatttcaaattcttcatcgtatggcgcgctttcgggcgtatcctggcgtgtaatgataaaccgtatctttttctcactcatgattatttcgccaccttcttcttcgagtagtcgcgtttacggggcgcaatcagtgatacatcgacatcctgatattcaaattccggagcttcaaacggaccggcatgtttagccattgtcgttttgagccactcatcgtcatttctttcagggaaatccggtttatagtgcgctccccggctttcatttcggttatatgcgccgagcgtgatgactctggcaagctgaagcatgttggagaactgacgggtgaacattgccccttggttgctccattttgtcgtatcgttgatattgattttcttaaagcgttccatcagctcttgaattttgtcatccgttttcaaaagcttgtcgttgtggcgcaccaccgttacgttagccgtcatccattctccgagctcacggtgaagcacgtaagcattttcatcgccgtccatcttcatgatatcggcccatttttcttcttcttttttcacataggaatcaaataatgaagaagacatgtcttccgctgatgtttcaagtcctgaaacatatttcaccgcattcggaccggcaaccattcctccgtagatggcggaaagcagagagttcgcccctaaacggtttcctccgtgcattgaataatcacattcacccgctgcgaacaatccgcggatgcttgtcatctgatcataatcaacccacaggccgcccattgagtagtgaacagcagggaaaattttcatcggaagcttgcgcgggtcatcccccatgaatttttcatagatttcgataatgccgccaagcttaacatcaagctctttcggatctttgtgcgaaagatcgagatacaccatgttttctccgttgatgccgagtttctgattcacgcatacgtcaaagatttcccgtgtcgcaatatcccgcggcacgaggtttccgtaagccggatatttttcctcaaggaagtaccaaggttttccgtctttatacgtccagactcttccgccctcaccgcgcgccgattcactcatcagacgcagtttatcgtctccgggaattgctgtcggatgaatttggataaattcgccgttagcgtagtaagctccctgctgataaacgattgatgcggcagatcccgtgttgatcatgctgtttgttgatttgccgaatacgattccgggtcctcccgtcgccataataacggcgtcagaacggaatgactcgatttgcatattggtcagattttgagctacgataccgcggcacgtgcgctcatcgtcaagaacggcgccgaggaattcccagccttcgtattttgtgacgagacccgccacttcatatctgcgcacctgctcgtccagagcgtaaagaagctgctgacccgtcgtcgctcccgcgtatgctgttctgtggtgctgtgtacccccgaaacggcggaagtccaagagcccttccggcgttctgttaaacataacccccatgcggtccaataagtggataatggacggcgctgcttcacacatcgcttttacaggaggctggtttgccaaaaagtcgcctccgtataccgtgtcatcaaaatgctcaaacggagagtctccttccccttttgtgttgacagctccgtttatcccgccctgcgcgcagaccgagtgagagcgtttgaccggaacgatggaaaacaatttaacggccgtgcctgattccgctgctttaattgtcgccatgaggccggcaagacccccgccgactacaataatgcttgattgactcatgatagcccctctccctctagtaatctagttctcttacacaaacgcaaaaattgcttttagaccgacgtatgaaagcgctaaaaatataatcagcgtcacgtaagtcgaaattctttgagaacgcggcgtgaccgtgatcccccatgtgaccgcaaaagaccataagccgtttgaaaagtgaaaaatgaccgataaaacgcctacaatgtaaaaaccgagcatgaacggcgagctcaaaatattcgccatcatatcaaagttgacttcagcgcccatctgtgcggcaatccgcgtctgccacacatgccagctgacgaaaataagggtgagaataccagtgacacgctgaagcacaaacatccagtttctgaaataactgtagtggccagcgttgtttttcgcagtaaatgctatgtacacaccgtaaaccgcatgataaattaaaggtaagaaaataataaaaatttctaacgcatacctgaacggcagactgtccataaagccggccgccttgttaaacgcatctgctccccttgcggcaaattggttgacgactaaatgctggatcaaaaagatgccgaccggaataacaccgagcaaggaatgcaatcttcgaaaataaaactctctgttcccagacattactttaccccctgtttgattcaagtgcgaaatgtgctaaaatctctgcccccacttcgtttcaattgtaagcactttattaaaatttattgacaatttcattttactcctccctcaaatgggcgtcaagaaaacgtgtacataaattataattttcggaattgattatttgacgggaaaattttattttcctgcgatatctttctcactttttttcacgtgttttataggatcatcctgtaatcctcccccctgtttaagctataataaacgaaggagagaggggaatacataatatgaagaataattatgaagcagctttagaacctttaactgaactcgacgtcagcgcatacggctacgaattaatccgggaaatcgtgcttccggatatcctgggcccggaacattcatccatgatgtattgggcgggaaaacgcctcgcccgcaaatttcctcttcaatcgtgggaagaaatccccgccttttttgaaaaagccggctggggaactttgacaaacaccggatcaaaaaagcaagagcttgaatttgaactggaaggaccgctcgtatccagcaggcttaaacatcagaaagagccgtgttttcagcttgaagccggttttatagccgaacagattcaattgatgaacgatcagattgcagaatcttatgaacaggtaaaaaagagagcggataaagtcgtcctgaccgtaaaatgggatatgaaggaccctgtataattgaaaaaaggcggtgactccgagtcccgcctttttgcctgcccgtttatacggcagacggctgtttagaaagctcaaacgcatcgtgaagcgcttcgaccgctttcaccatatcattttcgctgacaaccgttgatacttttatttcagatgtgctgaccatttttacttgtacatttttttccgccagtacggcaaacatgtccgcagcgacgccgggatttgagaccatgcctgacccgacaatggatactttcgccagctttctttcagtttcaattttttcatagtcaagcgcgtttttatattcttcaagcacagcgaccgtttgagcggcatcttccgttttcactgagaaagaaatgtccgcttccccatcgtccgcctgtgtctgaataatgatgtcaacgttgatgtttcgttttgccaaggcggtgaagatcgttgaaagtgttgtcagtccgcttgtcaggcctgtaacggacaccctcgtgatctggtcttcaaatgcaattcctctgacgattaaattctgctccattgatgattcctcctcaattaacgttcccgcttcatgttccgtacttgaccgtacttccaaaggcacttgatagtttttcgcaaactcaaccgcccgcgggtgaaggacacccgctccgagatttgcaagctccagcatttcatcataagaaatccccgccagttttctcgctgaccggacgtaccgcggatctgtcgtaaacacgccctgaacgtctgtgtaaatgtcacatttatccgctcctaatgctgcggcaagagcgaccgccgttgtatcggaaccgccccgtccgagcgtcgtgatgccgccgtcttccgtcacgccctgaaaaccggcgacgactgtaatccttccttcagcaagctgggcctgaattgccgtgatatcaatatccgtaattctcgcattgccgtggacggcttctgtgcggacacccgcctgccatcccgtataagagacggcgtcatatcctttttcctgaagcgccatggctaaaagcgaaatcgtgacctgctctcccgtagacagaagcatatccatttcacgtttacttggctcagatgtgatttccgccgccaggttaacgagcgcgtcggttgattttcccattgccgaaacgacgactacgacgtcatggcctttttgcttttcagcaatggctcgatttgcggcatgttgaattttttcggcagagccgacggaagtgcctccgaatttttgtacgataagacccatactagaccaccctttacattttggttcgtgcgggtgaggagaaaagagcgttttgttcacaataaaaaaagcaatgagaggaatagctctcattgctttttcatatcattacgattgattatgaacaacgagatagccctccaagaaaatgaattcttgacagccttacatttatttaatgcaaggccagcaaaacacaccgatgggatgtgattcacttcggcgacgctcccctttcagcttttctcgcagaatccatcattctcaaaaagcttactattgaagttcgcacctctatcttcaccttataacacgatcttatgaaattagttcacattctagcaggtttttcagaaaagcacaatactattttttcaatttttcaaacagcatctgagccgccgcagccggcacaccggcttttttaatatcgtcaaggcttgcttccttcatctttttgacagatccgaaatgctttaagagcatttttttgcgtttttcgccgattcccgggatatcatccaaaacggattgaaaggcgctttttccccggatctgcctgtgaaaactgatcgcaaagcggtgaacttcgtcctgaatgcgctgaagcaggtaaaattcctggctgttccgctccagaaacaccggttcaagcggatcgccgatcaaaaggttggatgttcggtgtttatcatccttcgccaatcccgctaccgggacatcaaggccgagctcattttcgagcacgtcgcgcgccgcattaatctgcccttttccgccgtcaatgatgattaaatccggcagcgggagattttcgcggagcaccctcgaatatcttcttctgacgacttccctcatagagccgtaatcgtcaggccctgttacggttttaattttatatttgcggtattcctttttattgggcttaccgtcaataaagacaatcatggccgatacagggtttgtgccttgaatattggagttgtcaaatgcttcaatccgatgcggcgtgtaaatgttcagcgcctcaccgagccgttcggcagcaccgattgaccgttcctcatcccgctcgattaatgagaatttttcccgcagagcgattttcgcatttttgtgcgcaagcaaaagcagctcttttttcgggccctttttcggctgatacacggcggtttccaaaagctcgctgatcatgtccctgtccacgctgtcaggcaccagaatttctttaggcagaaagtgattgtttttagaatagaactggccgatgtaggtcaggaattcctcatccgcttcctgatacatcggaaacatgctgacatcgcgttcaatcagctttccctggcgtatgaaaaagacctggacgcacatccagcctttatcgtaggcataagcaaacacatcgcggtccaaaaggtcattcatggtcattttctgcttctccatcgtcgattcgatgtgagcaagctgatcgcggaattctttagcccgttcaaattcaagcttttccgccgcctctgtcattttctcttcaagctcttttttgacctcgttatgccctccctttaaaaaacgggtgatatcttcaaccagctcgcggtttgtctcctcagaaatatctttaacacaaggagcgaggcattgtccgagatgataataaagacagacgcggtccggaagcttcgagcacttcctgagcgggtataggcggtccagcagttttttcgtttcccgcgccgcctgcacattcgggtacgggccgaaatagcgccctttgtcttttttgacattccgggtgacaataagccgcggatggcgttcatgggtgattttaataaagggataggttttatcatctttcagcatgacattgtatttcggatcgtattttttaatcagattcatttccaaaataagcgcttcaagattggaggaagtcacgatatattcaaagtcctcaatctccgtcacaagcctttgggtttttgcgtcgtgagaaccggtgaaataggatcgcaccctgtttttcagcaccttcgctttccccacgtagatgactgttttttgacggtctttcattaaataacagcctggctgatcgggaaggagggccagcttttctttcagttgtttattcatacgttacccttccttatattcatttctcgtgtccattcagtgtatcacgaacatttgtttttctccattctcagcttttggcagatcaaaaaaaggcgattcctctttaaaaaggaatcgccctgccgtaacggccgctttcggcttacagatgtttgtttacaagctcttcaagcgcttctttcggtttgaagccgacagatgtttcaacgacttctccgtcttttaacacaagaagtgtcgggatgctcattacgccgtatttaccggcagtttcttggttttcatcaacgtcgattttgacgattttcagtttgtctcccatttcttgatcaagctcttcaagaacgggcgcgatcattttacaaggtccgcaccaaggagcccagaaatccgccaatacgaccccttcacttgtttcagctgagaacgattgatcagttgcttttacgatagccatttgttattcctccaatgtcaaatgatgatttttagtatagcatctcccattcgttcatgctaatttaatgcttatattattttctcccgaactcctctgaattaatcttctttatatggtgtattattaccgatcagcaggcattcaaaacttaagatggatcagcaggcagcgtaattaaaactaccgccatcggaggaagctccgcctcaaggttttcgcccttttgagtaaatccggaaaacggcttcggtttgacgttttccgggctgctgaatgtattgcgggcattcattttttccgcatgcagaatcgttcccgaaggcttccctgcctttttcatgccccgcaattcaatcttcacgtcagctttgtgcagatgatcgatattgcaaatgctgatatgtatgtcgccgttttgctgtttggacgctgaaatgctgacctgcgggagccggccgtctttccattcgtaccctgcggcttttgtttctgatgccaaaagagaagcgtcctgatgaaccttaaacatatcaaacacatgatatgtcggcgtcaacagcatctgtttcccttctgtcaggatcattgcctgaagcacgttgacggtttgcgcgatattggccatttgtacgcggtctgcgtgctgatgaaaaatgtgaaaatgcgtggcggcgacaagcgcgtcgcggatcgtattctgctgatacagaaagcccggattcgtgccgggctcaggatcaagccatgtgccccattcatcaatgatcagaccgactcttttttccggatcatactgatccatgatggcgctgtgccttgtgatcaattcatccatatgcgccgcttttttcatcgtgatgaaccattcatcttccgtaaactccgtcgctgatccttttcccttccagaagtcgcccggtattgtgtaataatggaggctcagcccatccataagatctgcggcttttttcattaaggtttcggtccagcggtaatcgtcgacattcgcgccgccggcaattttatagatttcattaccgctgtaattgcggacataggtttgaaaatttctgtaaaggtcggcataatactcaggatgcatgtttccgccgcagccccagttctcatttcctattccgaaatatttcagcttccatggtttttcccgcccgttttcctttctccagtcggacatcggcgtgcctgcttcaaatgtcatgtattcaatccaatcagccatttccttaaccgttccgctgccgacgtttccggcgatgtacggttcgcagccgagcagttcacaaagcatcataaattcgtgcgtgccgaattcattggaatcaatcgtcccgccccaatgggtattcagcattgttttgcgtttccctacgccgtttgcccaatgatattcatcagcaaaacagccgccgggccatctgagaacgggaatctgaagctttttgagagcggatgcgacatccgtcctgatcccgtcggtattcgggatatcggaatcttttccgacccagatgccctcatatatacctcttcctaagtgttccgcgaaatgtccgtatatatttttgttaatggttgccctagtgatatcggtttgaataactgccgtattgtgagacaaacttgatcattcctttcccataataagaatgaaagcactacagtcaatctttgtatctgggatgtatgctgaaaggataagtttgtaagcgctttacagaaagcttattacattggttcggacatgtcaatctattattttatcaatgtataatttgtacgaactaattaccccaaatcaaaaccctctgacaaaagagccagagggttttgattatgaatgaatattggcatttttgaattcctgggtcagaagcggaaccacttcgaacaaatcgccgacaatcccgtagtccgctattttgaatatttccgcttccgggtctttgttaatggcaacgatgactttactgtttgacattcccgccaagtgctgaatcgctccggaaattccgcaggcaatatacaaatccggcgtgacaacttttcccgtctggccgatctgaagagaatagtcacaatagtccgcgtcgcaagcgccgcgcgaagcgcccaccgctgctcccagcacttcggcaagttcttttaacggttcaaacccgtctttgcttttgacgccgcggccgcccgcaacgataattttcgcttctgacagatccacgccgtccgctgtttttttgactacttcttcaatgaccgtccgcaaatctgccgccggcgccgcaagctcttcaatatcacccgtgcggctcgcgtctttttctaatgcctgaatgttattcggacggattgtcgccaagatgaaaggatcggttgaaatcacctgttcaaaggctttgccggaatagatcggtcttgtaaaaacgatgttgtccccggtaacgcttacatccgtgctgtctgaaatcaatcccgtttcaaatcgggccgcaagcttcggtgacaaatcttttcccatagaagtgtggccgaaaatgaccgcatcaggcttttcattttcgatcagatccccgagaaccgcggcatatccgtctgctgtatactgagaaagccccggtgtatcagccgtaaatactttgtcggcgccgtagtgaatgagttctggtgctgcatcagccgcgccttttcccatcagcacgccgattacatctcctccgccggaaatggttttgcctgcggctatagcttcaaaggtgacgttccgtaaggcgccgtcacgaatttctccgagtacgatcactttttttcccattctgacatcccccagtttctttaatatcagtttatacgactttggcttcttttctcagcaatgacacaagctctttcgcctgctcggcggcttctccttcgatcagtttgcccgcttctttttgcggcggcagaaaacgttcgatcgttttgagcttcggagcagcatcgtcctcatcaatgtcaaggtcatcgagctcaagttcttccagcggttttttcttcgccttcataatgcccggaagcgacggataacgcggctcgtttaatccttgctgtgccgtgatgactaaaggaagagaagttttaatgatttcggtatccccttcattgtctttctctgcaacagcttcatcgccgctgattgtcaattttgtaatcgttgtgatgcaaggaatgtttaacagttcggcaagtcttggcgccacttggccggagccgccgtcgatcgccacatttccgccgagaatcagatcatattcctgatctttgaaatagtgatataagatcgttgaaatggaatattggtcaggatcgctcaagtcatcttcaatattgattaacaccgcctggtcgcagcccatcgcaagagctgtgcgcagttctttctccgcatcctctccgccgaccgttacggcggtaacggttccgccgtgctcttctttcagctgaatggcttcttcaatggcgtattcatcatacggattaatgataaattcggctccgtcctcctgaatctttcctgcttcaatgacgattttctcttctgtgtcaaacgtccgtttcatcagtacaaatagattcatattcttatcccctttatcttcgcccaccgaattgaggctttcttttttcgagaaatgcctgaatgccttcttttgcgtcatctgatgcaaatgcttccccaaagcgctttgcttcaagctttaagccgccgtcataagaataaaccttgtttgtataaaggagctcaagcagaaaagccatcgactgcgggcttttttccgcaaacttgcccgccagcgttttcgccttttgcagcagctcttcctcatttgcggcgcctatggtgacaagcccgaggctgagcgcttcttctccggtcacaggttctgaagtgccgatcatttcaagcgctttcgccgtgccgacgtaccggggcagacgctgcgtcccggcaaagcccggaataatgccgagattcagctcgggcaggccgagctttgcatccaatgtagcgattctgatatgacaggccatggcaagctccagaccgccgccgagcgcagcgccgtgaatcgccgcgataacaggctttggaaacccttcaattttttccatcagctgctggcctttatccgccatggcagaagactgctcaaggttttcaagcgacgtaaattcctttatatcggcgcccgccgagaaaaatttcccctcaccgcgaatgatgatgcttctgacgctgtcatctgtttcataccggtcgaacagaccggacaactcgtctaaaatcgcaccggacagcgcgttggccggctgatgatcaatggtgatcaccgcgacagattgttctaccgccactgaaaggctgttcatccgtcaaccccctttagttttgatgaatccctgacaccaacagttccaataccttgtctgacaaatccggaagatcatatttctgatcgttcatcacccatgttgtcactgtttcatctatcgtcccgaatatcatctgccgggcgaggcggacgtcgagattgtctttccattcgcccgactcaattccttcggtcaaaatggtgtccagcatgtttaaataaccttttaaaatgtcattgattttcaggcgcagcttgatattcgactgtctgagctcaagctgggtcacaatcgcgaggtggcggtcattgccgagcagtgtgaaatgctgcttaatgacgagagcaagtttttcttttgccgtcgttttttctttcacttcttcttccatgcgttcaatgaactggcccatcttttctttaaaaagagaaatgagtatatcctctttgtttttgaaatataaatagatggtgccgtccgcaacgccggcctgcttggcgattttggacacctgtgattggtgatagccgttttccgctatgacttctactgctgcatcaatgatctgcatatactttggccgtttttggttcaatgtcatcgttccttccttcaataaatgaatgactattcattcataacttcatgataaaaaggaatccgggttttgtcaagtttttcttttaaggcactttgttttcacgggaagaatctgcctcttcgactaagcgtcttcttaatatttttccgacggccgttttcggaagctcttttctgaattcgtaaagcttcggtactttgtacggcgcaagccgctctcttgcaaacgcatcaagctcatcggcatttgcctcggcccctttttttaagacgataaatgctttcaccgtttcccctctgtaggagtccggcacgcccgctacgacgatttcttgaacggcttcgtgctcatacagcgcctcttccacctctcgcgggtaaatgttgtatccgccggcaatgatgatgtcttttttcctgtcggcgatgtagaaaaacccttcctcgtccatgtaacccatatcaccggtaaacagccagccgtctctgatgacacgcgccgtctcctcttgtttgttccaatagcctttcataacctgcgggccttttacgatcagctcgccgtgttcatacggctccgcaagcccgcctttttcttctgaatatattccggcatctgtattgggccaaggacagccgatgctgccgggtttattttttccccaaatgaagtttgaatgggtaaccggtgaggcttcagataatccgtagccttccacaagctttccgccggtcactttttcaaatttctgtttgacttcgaccggcagagccgctgaaccgctcggacagcttttgatggacgagagatcatatttgttcagttcaggatgatgcaaaatgccgatgtaaatcgtcggcgcccccggaaaaaccgtcggcttcagcctgtcgattgtttttagggtgtccaaggggttaaatttaggaagaaggatcatttcacacccctgcatgatggaaaaattgagcacggcggttaatccgtacacatgaaaaaaaggtacgatgccgagcaccttttcggctccctttttcattttgtacatccaggcggcgcacatttctgtattggcctgaatgtttcggtgcgtgagcatgacgcctttcggatagccggttgttccgcccgtgtattgaagcacggcaatgtcatgtgcagggtcaatatccgatagctccgcttcctccgctttttcttcttttaagatgtccgctaagctgtgaatctgttcgtggccgtcataatcaatatgcacctgttgtttttgcgtgagcgtataaagcatatttttcggaaacggcaaaaagtctttgatactggttgtaataatgcgctcgacgattgacaacgttttcatttttatcaccttcggaaagagcatatcgagggtgatgatcacacgcggcgcactgtctttcagctgatattcaagctcgtgttccgtgtagagaggattggtttgaacaacaatgccgccggcaaacaatacaccgtaaaaagcgatgaccgactgcggacaattgggcagcataatggcggctctgtcaccttttttcagacctgttttgcgtaaaaaagcggcaagctttaatgaatctgtgagaacgtcttggaatgtgagtttttttccgagaaaataaatggcggtatggtttgggaattgagctgcggagtttgtcagattggatggcagggtttgatcggtaaattcaagctcatgcggaatctcttcgggatattgagaaagccatggcttttcagactgcataaaacctctcccttctgtttttcctatacgctattattatagcagaaggctgattggaattggaaagcgtttcatgtgaattttgacgttcaggaggtgttgtcctttgctggaaacgatgcattttgaagagggagggagttcctattctgcgccagctgccgaagccttttacttcagccgcttttttgctacatccctttgtccgaatgccggatgggtgggaagagcaaaagcgcgagcggccttttgaacatatttatccgagtgatgaggagatcatcacaatgggcagacccgtttcctggaataccgtcatgaccatttgcggactgcgctctgaaaaagagaccgcgcttgcgcttatgaccgctgtcatggcgctgcgggatgaatatgcacagcctgaatccgccgagctgcttaatcggcttcatcctgcggatctgtacttgccgagcgatgatgtcacttcgccatttttgattccggggctcttagacgtgttccgttcaaaaggcattgagcgctgcatttattatgagccggtcgaagagaaaggtatattttcgctcaatcaaacggcgcctttggatgtatgcggactgctgaaggctgacatgatcattgccgataaaaagcgccgcgccgcttttatgagtatgtatgattctttcgcgacactctttctcatggaagatcaagacatgccgtctgtgatccgcgccatgaattgggaagcggtcatttgctctgatacgacctgcataaactggttttctcaataaaaaaaggccaccggatttagttcggcagcctttttttcagtattaagatgtcatgaccagataaataagtccgatgaacagaaaaattcccgctgccgacagcagcactttcgcaagcttctccatttttccccgtccccttaaatcccggcggccaccacaaatgacaggccgactgagatgacaaatgaaataaagccgacagctctgttatctttttcaatttctttatcaattttaaaccggggcgtcagaaattcaaagataaaatagctgattaaaagcataataaatccgtatacgccccagccgatcatttgcagcagcgaattatgctgggcgatgctgtgctgaaagacatttgcgatcccgagaattttccctccggtcgccattgcaaccgcaagattgcctttttggatttccacccagtttttataggatgtcaccaattcaaacacggtcagaaaaatgacaagacacagaacggctacactgtaataagccgcgatttcaacaagctcattttcccaaaaagcattcatgacgtttactccctttttattttagttcgacaatcgttacgcctgatcctccttctcccgcttccccgaaccgcgagcttttcacgctgcggtggtttttcagaagatcctgcaccccttttcggagggcgcctgtgccttttccgtgaatgatggacactctcggatagccggcaagcaccgcgtcatctaaatatttttcgacgcggctgagggcattttcgtaacgctctccccgcaggtcaagttcaagggacacgtgataatccttcccttttacggcggtgatggctttttcttttttcggttcaggagcggacttgagaaactcaaggtctttttccttcaccttcattttaaggatgccgatttggacattccattctttctcgccggttttttcaagcagcgcccctttttgtccgaatgtgagcacctttacttcgtcacccggcttcagctcgcgttttttctctgtttttctttccggctgctttgatttttcaaaagccggcatcgcgtctccgagacgttttttggcatcaatcagctcgtgttccttaaaggatctgtgttcttgcttgatagaccggagctcgcgaatgatctgttctgcttcttttgcggcgtcttccagtttttccgctgctttttgttcggcttcttccatcagtttgtctttctgggcgttcagctcaatgatttgctgctgcagctctttatgcagtttttctgcttcttttctgattgattcggtttcagaaagctcttcatccgctctttttttactttgttcaagtgacgcgatcatcagatcgacttcattgtgttcggcggtcatttctgacttcgcctggccgatgatatgctccggcaggccgaggcgtcttgagatttcaaaagcgttgcttcggcccggcactccgatcaggagcttgtaggtcggcgaaagcgtttcaatatcaaattcaacgcttgcattcatgacgccttgtctgttatatccgtatgctttcagctccggataatgggttgtcgcaagcactctggcgtttgtccggtggacttcgtcaagaatgctcatggcaagcgccgccccttcctgcgggtcggttccggcaccgagttcatcaaacagcacaagactgttttcggacacgtcttttaaaatactgacgatattgaccatgtgagatgagaacgtactcaggctttgttcgatcgactgttcatcaccgatatcggcaaaaacatgatcaaatacggcggcttccgatccttcatcagccggtatgtgcagtcctgcctgcgccattatcgtcagcagcccgagcgtttttaacgtaacggttttaccgcccgtattcggacccgtgataacgatcgtcgtataatctccgcccagttcaatgtcgttggccacgacttgatcttgaggcagcagcggatggcgcgcttttttcagacggataaagccgtctccgttcataaacggttttgtcgccttcatcgcttttgcgtatctcgcttttgcgaaaatgaaatccagcgtctgcagcacttccacattttgaacaatctcttgtgtgtgttcagccgtatgctccgtcagcatccggagaatccgttcgatttcctgtttttctttcaccttcgcctgctgaagcgagttgttcatatcgacgatcgcctgcggttcaataaacagcgtcgcacctgatgaagaagtatcatgcacgatcccgccgtagcttgatctgtattcctgtttgaccggaatgacaaagcggtcattccgaatcgtaacgatcgtgtcagacagcatttttgaagcggaagatgaacgcagcatcgattcaagccggtctctcactcttgattcaagcgttctgagctgcgtgcggattcctcttaaagcgggagatgcatgatcaagcacttcgccgtgatcatcaatgcaggaattaatctccctttccaaatcgcccaatgtaatcagctcttctgcatgggcctggatcagcggaatgctgacgccgtcttctgtcatttgactgataaagtgcttcatttgcttaacggcatacagcagcccggacaattcggtgaattccgccggggtcagcacgctgccgatttccgcccgacgcaaagccgatcttatatcggtcagaccgccgaacggagcatggcctcttaagcgcatgatcgcggatgcttcttcgacttcatccagctgtttttggatgtcggcgagatcagtcaaaggcttcagctgcagaagcttttcccggccgagcgatgaggcggcatgtgcggtaatctgttcttttactttatgaaattcaagtgatgataacactttttgctgcacggttttgtggtcctccttacttaatcattgcgcgtcagaaatgctttgacctcatgtagcggccgggcgtttaaaacattctttgtttctgtccagcctttgcgcgcagcggtcacgcccgttttcatgtcatcgagcatctctatattatgggcatccgtattaatgaccaaagtcacgcctttttcgtttgctttgatcagatgctcagtccgtaaatcgaggcgcgcggggtttgcattcagttcaagcgccgtatttgttttggcggcgagttcaatcagcatgtcgatgtcgacttcatagccggcccgtcttccgatcagccgtcccgtcgggtgggcgataatatccacgtgcttattcgtcagcgcctgttcaagccgtttcataatgacatgttccggctggctgaagcttgaatgaatagacgcgatgacaagatccatttcagacaggacactgtcatcataatcaagtgagccgtcggggagaatgtccatttccacgcctttaaagatatggaagttttcaaactcggcgttcaacgcgtcaatttcttccgcttgttttctgagccgttcggccgttaacccattggccacctttaaatattgggaatgatcggtgatcgccatgtactgataaccttttgccatacacgcttctgccatttccctgatagaaaaagcgccgtcactccaagctgagtgcatatggagatcgccttttatctctttttgctccacaaggtccgtttcttcccgatacgtgtcgacctcctgcccgctttctctgagctccggaggaataaacggcagaccgaagtgggcgtaaaaggcttcttcgctcgggaaagttttgacttctcccgtttctatcgtttcaaccccgtattcgctgatccgttcaccgcgctcttttgccagctggcgcattctaatgttgtgatctttggagcccgtaaaatgatgcagtgtggtcgcaaactgctcctctgtcacaagccggaaatccacactcgtctcatattcaaaggtcaggatgactgatacctttgtatccccgctcgctatcacgtcttttacgttcggcagggacagaagctggtctctgacagccgccgggtgatctgtggcgataatgtaatccagatcttttacggtttcccgcgctcttctgagactgccggcacgggaatatttctgaatatccgtcagcccggccaaatgttcttcaatcactgaagcaatgctgagcgcatagccgatcggaaaacgttcaggctgttttccggcttctccgagagcctggaggattttctcctctgtttttttgccgaaaccggcgaggccctgtactttttgctgctcgcatgcttctttcagcgattccgcgtcatgaacgcccagctcttgatacagcttggcgattttcttgccgccgaggcccggaagcttcaacaaaggaaccaagccttcagggacttctttctgcaattggagaagcgtgccggacacgccttcctgcatatattcacgaatgacgctataagtgccttttccgatgccggataaagacatcatgtcgtcgatttccgacaggctgcggtcatcctgctcaagcgccgctgccgcttttcggaaggctgatattttaaacgggttgtcccctttcagttccatatagaccgcaatcgtttcaagcagcctgataatatcttttttatgcatactgttaacccccagtcgtttcctgcttttcatcatacaaatttttctcctcctgcacaactgacgcagagcttgaaaaaaacttctccggtcaagagaagttttttatgccccgtactgggcccacagttcttgcagaagccctgacagatacggcgtatgatgtgtgatgatatccgcaagcgttgattgtgcgagcatatcttgaagcgcgcttacaggcagtacggatgcgacgtataacaggataaacgcaaatagatagacttccagaaacccgagcaccccgccaagcagtttgttgatctgtttaatgaccggaatgctggcgatgatattaagggccgctccgataatccggagcagaatctttgcgatgataaacaaaatgacaaacgcgatcgcattgtaataagccgtctctacgtttccattaataaaagaaagagccgcctggccgccggaaaaatcaggcgcaggtataaagctcaaatgcggcgcaaggtttttgtaaaaaagcgccgcaaacgcaatcgaaaggataaaactcgttaaatatataaattggaggataaatcctctcttcaatccaagcaatgtgcccatcaagagcaaaactaagatgatgatatctatcatatggtgttcattccttttctttaagctgccgctccagtatttcatatttttcttgcagtttcatataatcatgcacgacattgaccgcagtcaaaacagcgagcttatttatatcaagatatggatttttctcgttgatttctctcattttatcatcaaccattccggccacatgacgcatgtgcgctttgctttcttccccgataatggtgaagtgctggccgtaaatgttaactgtcgttttggtttttttgccgtcagacaacgtttctcctccattccgcgagaatcctagttcctatcataccacgattatcgtttgaatggaaagacgagcctcgggctgttatgatacactggtatatacagtgaaaagtgccaaaaaaggagattatatcgtgtcccattctgttataaaagtatccgcttccgctatagaacaaatgaaacattcctatgccggctcccttacttccgccgttccgcagggcgccgtcttccaggctaagcctccgggctgtaccattacagcctaccgttcgggcaaggttctctttcaaggaagaaacgccggcacagaagcggcccgctggggaacggctgaggcgccgaaggcaaagaaaaccgtcaaaaaagcggccgatccgatctacgctcccccggcgggcattgcgtccatgtcggtgatcggctcagatgaggtcggaacaggcgattatttcgggccgataacggttgcctgcgcctacgccgacaaaacaaagctttctttaatgaaagaactgggcgtcaaggattcgaaggatttaaaagatccgcagattattgaaatcgccaaactgttaattaaaaccattccctacagcctgcttgtgttaaaaaacgaaaaatacaatcagatgcaggaaaaaggcatgagtcaaggaaaaatgaaggcgctccttcataatcaggcgatttccaacctgctgaaaaaaatgaacggcgtcaaaccggaagcgattctgattgaccaattcgcagagcctggcatttattttaagcatctttccgggcgggatatcgtaaaagaaaaaacgtttttcagcacgaaggcggaaagcatacacctttccgtcgccgcagcctctatcatcgcgcgatattctttcttacttgaaatggataagctttcccgtgaagccgggatgacgatccccaaaggcgcggggccgcacgtcgatgaagctgccgccaagctgatcatcaataagggagaagatgcgctcagaacattcaccaaacttcattttgccaatacgcaaaaggcgaagcgtcttgtcgaacggaagcggtcataataaaaaaaagcttgcagagtgatctgcaagcttttttctttagcctcttaatacggcctgatacgtttcttccaacgccttcagcacgttttcatggacttttgtcacttcttcttctgtcaatgtttgttcaggattaacatattgaagcgagaaggcgacggattttttgccctcttccatatgctcgccttcgtacacatcgaagacggtgacttctttcaacagcgcgccgccggcatctttgataacggcttcgagctgtccgcttgtaacggttttatctgcaacaagcgcgatgtcacgcgtgacggacgggtatttcggaatcgccgtgtacacgagaggttctgtttcttcggtcagaagcgcgtgcagatcaagctcgaacacatacgtttctttgatatccagctctttttccattgccgggtgcacctgtccgataaatccggcaagtgagccgttcaaaagaatgtttgcggtccggccgggatgcatgtttttgcgttctgactggacaaattcaatccggtctgacacattcaattgatgcagcaggccttcaacgatacctttgacaacgaagaaatcaaccggctttttctcaccctgccataagtttttgcgccataatccggttacagctccggcaacccgttctttttcaacaggttttgtattttcttccttcgtcagaaatacagaacccgtttcgtataaagcaacggaatcagtctgtctggccaggttgtatgaaacagcttcaagcagattcggcacgaggctgtgtctgagaatgcttctttcttcgctcatcggcagagccagcatcgtgttgaatgatttttcgatcgcaaaagcggccgcttttttatcattagtcaatgaataagtggtcgcttgagaaagacccgctccttcaaggaaacgtctcactttccggcgttttgcctgatacggggtcaagccgcctgtcgtgccggccgtttccggaagcgtggacggaatattgtcatacccgtataatcttgccgcttcttcaatcaggtcttcttcgattttaatatctccgcggcgtgacggcaccgttacaacgagaacgtcttcagcttcaccgactgcaaaaccgagccgcttgtaaatgctgatgatttcttccttagcgattgtcatgccgagcacggcgttcactttttcaactgacacgtgaatgttgttcgcttcgattttcagatggttttcttcaaccgtgcctgacagcacttctccgcctgcatacgcctgaatgaggctgcaggcccgttcagctgcaagcagaacgcgtgccgggtcaatgcctttttcatatctggcgctcgcttcgcttctcagcccgaggtctctcgacgctttgcggacggtctgtccgtcgaaataagcggcttccagtaaaatcgaggtggtgtcttcacggacttcagactcggctccgcccataactcccgcgactgcttgcgccttttttccgtttgtgatgaccaaatggctgcttgacagcttgcgctcctgttcatcgagcgtcacgatggtttcgttttccgccgcttttctgacaacgacctcttttgaaccgaaccggtcgtaatcgaaagcgtgaagcggctggccgtattcaagcaggacgaagtttgtaatgtccacgacgttattatgcgggcggatgcctgcattcatcagcttcgtctgcatccaaagcggtgacgggccgattttgacgtttttaatgattttcgcggcgtaatgcgggttggcctgcgtatcttcaatcttgacggaaacagcgtccgccgctttttctgccgctgtttcatatgaagtctccggaagctttacctctgcgccaaggatagccgcgacttcataagctacgccaagcatgttcatcgcgtcggcgcggttcggcgttaagcccaattctaaaatcgcatcgtcaagctgaagggccgccattgcgtcagctcccgtttcagcatcattcggaaacacgaaaatgccttccgcatattctttcgccacgagcttgctttcaatgccgagctcctgaagggaacagatcatgccgtgagatgcctcgccgcgaagcttggcttttttaattttgaaattgccgggaagcacggctccgaccgttgcaacggcaaccttctgtcctttatcaacattcggggcgccgcagataatctgcacgggttcctccgcaccgatatcgacaaggcatttgttgagtttgtcggcattcgggtgctgttcacgttcaagcacgtgtccgatgacaacgccttttacgccttcccctttatactcgataccttcaacttcaataccggctcttgtaattttttctgcaagcacggccgggtcgattccctgcaagtcaacgtaatcttctaaccatttataagaaacaaacatgtgtatcctcctcttacgcctgtttaaactgcgaaatgaatctgacatcattggtatagaaatggcggatatcttcaatgccgtatttcagcatcgcgatacgttcaacacccattccgaaagcaaaaccctggtactcttcaggattgaacccggccattttcagcacgttcgggtgaaccatgccggcgccgagaatttcgatccagcctgtttttttgcagacggagcagccttgtccgccgcacttaaagcaggtcacatccacttcgacagaaggctctgtgaatgggaagaagctcggacggagcctgatttcacggtcttggccgaacatttttttcgcgaccaattcaagcgtgcctttcaggtcgctcatgctgattttgcggtccacgacgagaccctcgatctgcatgaactgatgggaatgtgtcgcgtcatcgttgtcacggcgatacactttaccgggacaaatgattttgacggggccttttcctttatgtttttccatcgtgcgtgtctgcaccggtgacgtctgcgttctcatcagcatttcttctgtaatgtaaaagctgtcctgcatgtcgcgggccggatgttccttcggcagattcagcgcttcgaagttataataatccgtttccacttcagggccttcttctacggtatatcccataccgataaataaatcttcaatttcttcaataacgaccgtcagcggatggcgtccgccgatgtttaccggactgccaggcaatgtgacatcaatcgtctgactgctgagttttttattcatctcttcttgttcaagctgttcatttttcgccgttatggctgctgcaatgcgctctctcacttcattggcgagggctcccattttcgggcgctcttcggcggacagtttgcccatgccgcggagaacttctgtaatcggccctttttttccgagatattgcacccgaatatcgttaacttcttttaatgaaccagccgcttctactttttctgcagcttccagttcgagctgtttaagcttctcttccatcatgcatcctccttttatgtaaaccaaaccgttctatgcctttttcagaaaacaaaaaaacccgccccttagagaagggacgagttgtggccgcggtaccaccctttttaaggcagacttcatctgccgaaagcttcattgacataacggaaacgatcgttccggttcacctttacgcgcgtttggcgcggtcccggtgacaactcgagaggtgaaaatcaatttctgtgctgcgataaaaatgctttcagtcagcggcattttctccctggaaggcagtgtgtgcaaaaattgacgtcctctgtcacggtttttacattattgctatctattatagtgaaattcgcggctttgcgcaacctatcctctaagatgatatacgaggattgcggccgctaccgccacattcagcgattccgcctgtccgtacaacggaacatacaggttgagatctgttttttgcagaaggccggcgtccactcccgctccctcgttcccgacgattaacgcgaacgattcttcaggcttcacgctttgataaaccgcaccgttttcaagcgccgtgccgtagatcgcgacaccttgtgatttcagctcatcgataaactcatcaagcggacgtttcaaaatgggaatatgaaagtgagatccttgggcagaacgcagcgtttttccgctgtatggatctgccgtcccgtcaccaaggacaacggcgtcgatacccgccgcatccgccgttctgatcattgttcctaaattccccgggtcctgcacggcatcaatcagaaggagccgcttcagcggatcaggcttctcttccggcatatggcagactgcggcgatccgctgcggcgtttccgtttccgtcacggctgaaaacgcgtcttcgctcagcacataacaaggaatgctcatgtccagatcggctgggatggcgctctcatcttttacgagaatttcttttaccgttccctttgatttgagcgcttcttctgccagatgctctccttctatcagaaatgtattcgttttaagtctctctttttttgtgtgaagttttttccagtccttcactttttggttttttgcagagtcgattcgtttcactttatttctgtgctctccttttttcatgcatgttgttattatatctcaagaacagcacataataaaccgcgtgcgcggtaagaatatgcgtatcacaatcaggaaaaaggagcggttgtaatggatcttaatttacgcaacgccgttattgccaatgtaaccggcaataaccaagaccagctggagcacactatcgttgacgccatccaaagcggtgaagaaaaaatgcttccgggcctcggcgtattattcgaagttctttggcagcatgcgtcagaatcagaaaaaaatgaaatgctcaaaacacttgaaggcggattaaagcctgcgcaataagcatgaaccgggtgatggcacacccggtttttttgtataataacggcgagggggatcgccatgcagttacagccggaactggcaaagaaattgattgccgaagtcaaacacatgtacagccgcgaagtgattattgccgatacaaaaggaatgatcatcgccggcaccaacgaagcgcgcgccggatgttttcatgaaggcgcactgatctgcgcgcgcgaaaaacggaatgtcatcatcacgaaagaagatgaaaaacggctcgagggcgtaaaagcaggactgaacctccccgttttttcgggtcatgaggtgatcggagtattcggtctgacaggaaaccctgacgatatcctgcctttcggagaattgctcagaaaaatgacagagctgtttattaaagaaacgcgccacatggaagaagcgcagtggcgtgcgagaatgcttgaatcttttatggttgattggctgcagttaaaagaatggtccccgggctttatagaaaaagcaaagctcctcggcgcagatctgcattcacaccgccggatcatactcattcaagaccgttataagcaatataaagcagaagagctcaggcgaatctggcagaacgaatgccctgaagacctgtttgtccgctggggaaatgaacgcattctcattaatcatgaaacaaattcaagttccaaacagcagctgatcaaaagaatcggcgctgtttttgggcagcctgtcacggccggcatcggtcggattgttccgggagagcgcctcacggaatcatacggacaggcggagaaagctctttcggcaggcattgctgacaagcaggccgtctttgaagaagatttaaaactggatatgtgtcttgccgaaattgcgcccggcacacggtcggaattttcacgccgtgttctcaagcatgtgctcggccgtgaagaacttctggatacgctgcgcgcctttttcaaccggcaattatcgttaaagcgcaccgctagcgacatgcacattcatattaatacattgcgctaccgtctttccaaactggaatcattgacaaatatgaagcttgaccgccctgaagacattacggctttttatttggcgcttcgctttttagaccaacatacaaaaaacacgtaatctcatcgtcatttttcatatgtttctccatagtgcgcggaatcatttttctttacaattaaatgaaaacgcttttctaatcagggaggttgggagaatatgatttcacgagaggcaaaggaacagttcattctggcggtcggagaggagaattatgatgattcggcggcggggcgtcttgtgtattcgtacgatgcggcccctcagctgcaggccatgccggatgcggtaatagccccccgctgcgcggatgacgtatcacgtatactaacgatttgcagcaggtatgacattccgatcgtgccgaggggttcaggcacaaacttatgcggcggcacatgtccgtctgaaggcggtcttgttcttttattcaaacatatgaaccgcattctcgaaattgatgaagaaaatttgacggcaaccgtacagcctggtgtgattacgcaagatatgatccatgcggtggaacgaaaaggtttattttatccgcctgatccgagcagcatgaaaatatcgaccatcggcgggaatattaatgaaaattccggcgggctgcgcggactgaagtacggcgtcacccgggattatgtgctcggccttgaagcggtcctggcatcaggcgatatcatccgcacaggcggaaagctgacaaaggatgttgcaggttatgatctgacaaggctttttgtcggatctgagggaacgctcggcattgtgaccgaagcgactttaaagcttgttccgaagccggaaacgaaaaaaacgctgctcgcactctatgaacatattgaagcggctgcggaatctgtttctgccattattgctgaaaaaatcattccagcgacactcgaatttctggatcagccgacactgcaggtcattgaagattacgtcaagatcgggcttccgaccgacgcaaaagccgtcctgctgatcgaacaggacggtgacagcgatacggtcagacgcgatatggaaaaaatcgaagccatctgtaaaaacggagccgccgcatcggtccaaacggctgaaaccgaggaggaggcattcgcccttacagaggccagaagatccgcattatcagctcttgccagactgaaaccgacaacaattctggaagatgcgaccgtgcccaggtcacaaattgccagcatggtcagagccattaacgagattgcagaaacatacggcttgtccatctgtactttcggccatgcaggcgacggcaaccttcatccgacgtgcaccaccgatatcagaaataaagaggaaatggaacgtgtcgaaaaagcctttgccgccatttttgagaaagcgattgagctgggcggaacgataacgggtgaacacggggtcggcatcgtgaaagcgccgtatttagaaatgaagctgaaaacagaaggcatcaccgcaatgaaagccatcaaacaagcgctcgatccccaaaacctgctgaatccgggcaaaatattcgccaattcatcaaggaaacgcgtggtggtgatgaaatgacaacagctaaagaacagaagcaaattcaaaaagaattcaaaagccggatggatgaaggtgaattgctgaactgtatgcgctgcggcttctgtcttccttcctgtccgacctatatagaatcgggatttcaagaatcccattcgccgcgcggccggatcgccctgatgaaagccgtcacagacggactgatcgagccggatgaagatgtcgagcgctcactttcgctgtgtctcggatgccgggcatgcgaacccgtttgtcccgcaggggttaattacggacagctgcttgaagaagcaagggatatcattcatcaaaataaaaaacataagccgggcgtacgccttttgcggaaagccgcctttaccgggcttttccctcatcaaaaccgcatgcagacagcggcaaaccttctcgggatatatcaaaggtcgggattgcaggccgccgtcagaaaaaccggtatgctgtgcgttttgcctgagcatctgcgcacaatggaacaagtgcttccgcccgtcccgaaacggaaagacatgaaggaacggccgcgttttcttcctgccgcgggctccgttaaaaaacgggccgcttttttctcgggctgcttaatggatacgatgtttttagcgacaaatcatgcgacaactgcgctgttacaggcggccggatgtgaaatcgcggttccggagggtcaggcgtgctgcggcgcgcttcacgggcacagcggagaaaaagagacgggaaaagaactcgccaagcggaatatcgcggcctttgaggcgcttgacgctgattatatcattacaaacgccggcggatgcggcgcctttcttcaggaatatccgcatttactaaaagatgaacctgaatgggcggagcgcgcaaaacaattcgtccggaagctcaaagatttttcatccgtactggttgaactgaagttccatcaaagggacctacgggcgcggtcccctcatatcgtcacatatcaggactcctgccatctccgcaatgtgatgcatacgtcagaagagccgcgcacgcttttgaaaagcattaaaggggctgagttcagagaaatggaaaaggccgacagctgctgcgggtcggcgggaatttataatataacagaatcagaaatgtctatgaaaatattagacagcaagatgaaagctgccggaaaaacggaagcggccgtcatcgtgacagccaaccccggatgccttctgcaaatgcagctcggcatcttgcgtgaaggcataacagaccgtgtccgcgcggtacatttggcggattaccttctggaagcggcggatttgtcctaaaccgaaagcagagagaccgatcggctctctgcttttatgatgctgcaatgttctgatcggcggcggatttatccgggtattgaagcctccagtctggcactcggatcacgccatacgtttgcccatttcttcacagccgcaatgataatcacaagtccgagaatgagcatgataatggataaaacaccattcagcacattgtatcctgccgcttcggggttcaaatacacatacctcaccatccaataccccgcatagttgacggtgacgtacaaataagcgaggggaatcaagcatgtcagcatatagcgccgcttatcggctattttcaatacgacggtcgcaccgatgattaatccgacagaagccataagctgattggacacgccgaacagcgcccaaatggagctgatgtcgccggaatacagaagatagccccacagcaggcaggcgagcgcgcttgagaaaatcgagcccggcagccaatctgtttttttcagcggcttatatacctctccgaaaaactcctgaatcaaatagcgggcgacacgggttcccgcatcaatcgccgttaaaataaacaccgcttcaaacataatgacaaattgaaagaaatatgaagccaaatgactaaaaaaaggaatttccgtaaaaatataagtcattccgacggcaagtgtaacagcgcctcccgtccttccttccagactgagcccgattcctttgctcaattcaggcaggtggatgacattcatcccgagcgtgcggaatatttcaggcgtgctgttaatggcaaaatagtcggcaggctcgagagcggcagcagcaataagcgccatgattccgacgagacattcaacaagcatcgctccgaaagcaacaggctttatatcactccatttatcaagcattttcggggttgtgccggaaccgacaaatgcatgaaagcctgaaatggcgccgcaggcaatcgttattgaaataaacggccagacaggacccgcgatcaccggtccgccgccgtgaataaactctgtcactgccgggaattgaacggctggatttacgaaaaagacacctgcgattaatgcggcaaaaaccccgattttcataaaactgcttaaatagtcacgcggggcaagcaaaagccaaaccggaagcgccgcggcgaaaaatgcatagacgggaagcgccaccgcgagtgttttcgcatccaatgtcagcatgtcgccgagagccgttgtttgcagccacggcccgatcacaacaccggccatcagcaaaagaaaaccgacagttgatgcaagtttgagattgcccgtttttttatagtagacgccgacccccatggcgatcggaatcgtaatccctaccgcaaacgttccccacgggttttgctcaagcgcatggagcacaaccatcgacagccccgccatcgtgatcgtaatgataaacagcatggaaagaccagtgcaaaatcccgccaccggaccaagctcttctttggcgacttcagaaagcgtttttccgtttttacgcatcgatgcaaacaatacgacaatatcatgcacggctcctccgatcaccgccccgattaacagccataaaagcccgggcagatagccgaactgtgccgccagaatcggtccgacaagcgggccggcggcagcgattgccgcaaagtggtggccgaatgacacccatttattcgtcggcacataatctttcccgtcctcaagcacatgggccggagtcggtgtctgatcattgatttttaatactttgaccatcataaaagtaccgtaaagccgataggcgatcgccaaaatacatatagacgctatgacgattgtaatcgcattcatttaatcccagccccttttctctttttctaaatattatcacaattatcaaataacaggagatgattttttgcgtaaaaaaagccgggctttgtcgccggcttttcggaacattattttcctgataaacggatgacattccaggacagcggcgtaaaatgagccgttattccttcggcgcttgcggaagatgtcccgttcgcgtgcggaatgacttgttttctgtttttttgattggtcgctttcatatcctgatgctcgagcacgatatgctcaatgatgcggtaattttcaaatcctctgagctttatctccgtttccatcagttccttgcttttgttgacggcaaaaatggtcagggtttcatcctcttcatggtaaacggcggcggcatcaacatacggtacatccgtaaaatccgcggagtcgtatttcggggaggtcaccagcagcttcattgaagtccctcttccatagacagaggcgtgcatgtaagggtaaaagatcggctgcctccacgcttctccgcccttttctgtcatgataggcgcaatcacgttgacaagctgggcgagacaggcgatctttagtctgtccgcatgctgcagcatcgtaatcagcaatgagccgatcaacagcgcatcttcaaaattgtagatgtcttcaagaatcggccgggccgtaatccacggttccacttttttatccgcttcatttgagtgataccacacattccattcatctaatgaaagctgaatcgtttttttgctgcgctttttcgctttcatataatcacatacggctgttacagatttgataaaatggtctaaatccatggacttcgccaaataattttcaagatcattttcatggttgccgtaatacgtatgcagtgagatgtaatccacatgctcgtacgtatgctccagcacctccgcttcccactcgataaaggtcggcatgccgctgtttgagcttccgcaagccaccaattcaatcgtcgggtccgtccatttcattacctttgccgtttcagcggcgagccgcccgtattcgtgcgccgttttatgcccgatctgccaagggccgtccatctcatttcctaagcaccatgtttttatgccgtaaggtttctcatacccatgcgattttcgtaaatcgctccagtatgacccttcaggatggttgcagtattcgacgaggttcctggcggcgtcgattcctctcgtcccgagattgaccgccatattcacttcggcattcactttttttgcccacgttaaaaattcattcgtcccgacttcgttcgtttctgtcgtctgccatgccagatcaagccttcgcgggcggtccttcacaggtccgacgccgtcttcccaattatagccggagagaaaattccctcccggatagcggatgaagggcacctgcaattccttgatcagctcctgtacatctgttctgaaaccgtcctggtcggctttcgggtgtccgggctcataaatgccttcatacaccgcccggcccatatgttctataaatgaaccgtaaatccgtttgtccacttctccgatgatatattctttatctaccgtaattcccgcttttttcattatgtttcctccctctctatcccttcactccgccgactgtcaggccggaaatgaagtatttttggaaaaacaagaatatgatgatgaccggcagtatcgcaaaaacggaaccggagatcagcatgtcatagttattgccgtacggactcagcagccctgaaagcccgattggaagcgtaaacatttctttcgaccgaagcacaatcagcggccataaaaagttattccagctgtttaaagattggagaatgatcattgctccgaatgccggtttcataagcggcgccataattctgaagaaaattccgaattccgtgcagccgtccattctcgctgaatcaagcagatccttcggaaggccgagcgcgtattgcctgaaaaagaacacggcgacaggcgacacgataaacggcagaatcacccccgtataagaatcgatcaaatgaaggcccaccgtcagtttaaataacggaagcatcatcacttcaagaggcaccatcataatgatcagcacaagaacgaaaataacatttctgcctttaaactcgtagacaccgagtccgtagccgatcatagaggaaaaaaacagcgtgagaaccgtggtgagaacgccgagcagcaggctgttaaaaaaccacttaaaataaatgcttcccccgtggaacaaatacgtgtagttatcaaggctcatcacatccggatcaagacgcagattcagcccgatgcgcatcagctcagatgacggctttaatgaaccgagcagcaggcagagcaacggaaagatatacagcaggctcagcatgataaaaaacaaggtaaacgcaactctgtacacaagagacatgtgattgtgacgcaccgcttatccctcccctttaaacgaaccggacagtttcagcgagacaaggctgaccagtaagatgatgagcaaaaggacaattccgattgcggcaccgtaccccatttcgttatacgcaagcccctgctgatataaataaccgacaagcgtaaggccgatattgcccggggaattattctgccaaagcacatagctttcctcaaacattctgaacccgccgataatactgatcgttaacacataaacggacaccggcttcaaaaacgggagagtaatatgccggaactttttccacgtactcgccccgtcaatttcagcggcttcatataattctttcggcacgttctgcaatccggccaaaaaataaagaatgttaatgcccatccatctccatgatgcaaggagcaccattaaaaacatcccggttcctttgttgttgagccagttttggggcgatgcgccgagcttgatcatcagctcatttgccagcgatgtattcatttctccgaacatcagccggaatataatgcccgctacgattgtcgatgttaaagccggtataaacagtgccgatttaaatacatttctgaacatgacgagcttcgaattcagaaacaccgctaaaagaagcggcaccggaatcagcacgacgagcgtccagaaggtatattccaatgtattgaataatgcggtataaaaggttggattaagaagagcggtataattggaaaacccgacaaatgtaacttctcccggcagtatccgctgaaaactcatgataaacacactgatgatcggatacaaaaagaagacgagaaacgaaatgataaaaggcgccgtaaatagataaggcgccgctttttttgaatacagcacattgcgccggcgcggctctctccggactgcagaaacggtttgcgctgactctgtctttacaggtctcataaaagctcccccgctttctctgttaaattgggcggcttcttatttttccaattgctgtgccgcctcgtccaaggcttcctcaggtgttttttcctgcgtcttaagcgcatcgaacagcacctgtctgactacgagatcagccgctttagagaagtcttcatgcagataaatcggattgatctcatcttttatctcaaggagtgaggaaaaaatggacgtaccgttccggaagaaatcagtgtacttgtttttctccttcaattcttttgaattccacacgtcccagcggagcggatcaaagccgagcaccgtccacagcttaatatttccttcctttgaacctttcgcaaatccgagaaattctttcgcgagctccagatgttcagcctgtttcggcacgacggtggctgttccgcccaagcccgctgatcggtcaccgccttctttccaggccggcatagggtaaatcgccattttcccttttaagtcaggcatataatcgataaaccgccccatgtaccaaatgggcatcagcactgacgccgccccgctctgattcataaaaccgtagtattcttcgctgtgatggccgccgccgggagccggcagaagggttttatcatttaccatgtcctttaagtaattcaatgtgtctatattcgttttactgttcagaatcaatttgccgtttttgctgaagtagcctgatccctgctgcgaaatcatggaaaggaatgtggcggagtcatttgtttcaaccgttcccatcggttttcccgtaatttcgcgcacttttttccctgcccgccggtaatcctcccatgtcttaatggaggcaggatcaacgcccgcttttttcatgatatccatgttgtaaaacatgacggtcgtccccacatgtgtatcaaggccgtacaatttgccgtttttgctgtatagggcaagacgcgcctccacaaacttatcgcggtctttttcaatcagcggagtcagatcggcaagcgggatatcctttcctttcagaaagttcgagaaccggcttaattccacgtcagctatatcgggaagcccctcacccgcgatcagcgaaacagatagattatcatgcatttgtccataaggataaacaacggtattcagcttaattttgcgctccgggtatttttgattccattctttgaccatttcctgatagaactgttcgtgcagtccgttaaacgtccaaaaagtcagctccgtttctcccggccggccggcagcccgttcttttgaacagccggcggtaaacaataagagcatcatcaccaccaaacatacagcggtcgtttttttcatgtcatcccccctccactttaggccgcgcggctattgaagcaaatgatgtgcaaagagcgctgcatgttcatttatgatggtcaaaccggtataacggtctctcagtgtgtgcgcatgcttaagcgcgtcgcagacaagttccttcttgacaccgatttcatcgaaacaggctggacctcccgcagatgtgagccacccggcaattgttttgccgtcaggaagcccctcatatgctgattgaatcgccttgcgaaagttcggcggcagttctgcaagcttttcgtgacaagccagttctttgtaaatatcactcagcaccgcgcaggcgcatcccaccttcgcaccgtggagaatcggaggctgttttgtcttcagcatttccatctcaatccaatgcgagatgtgatgctctcctcctgaggcgggacgggagtgatcaagggcaagcatgacaaggcccgaaacgatcagcgcttccatcagtatctcaatgccggtctctgtccccgcggcaatgccagcgcggtgatcaatgcactgccaaagcgcgtctttcacaagcttcgcccctgcttctgagtatggctcatctgcaagcctgcgggatatctcccaatctgccagcgatgttatttttccgagcatgtcgccgaatcccgcggctgtcattgaacggggcgcgtcttttaaaagattcgtatccgcaaagagggcgatcggcgctttcgtttgaatcgtcgttttgattccgtttaatatgagcggcgctccggccgatgtaaaaccgtcgactgacggagcggtggggaatgatataaacggcaaaccgcgctgataggcggcaaaccgtgtaatatcgtgaatcgtccctgaaccggccgcaatgattacatccgtctcttccgcgatattgatcagcgtatagaccagtgtcctctcatcagccgcagcggtcccggcttcatgctccggaatgatgagctttgccgctttaaccccgccggccttcaattcgtcagcaagcacccgtcccgctgcctcgtaagtgttccgatcacagacgatcaccggatgtttccagcattttttttgcagaaatctgagaagttcttcttttgcagtcgctccgatcacgatatcttctatttgaataggcgagcggctgcccccttctctgtcaaactcggattgaatgtccgccggagaaagtttcataaaaggattccctccttcgctaattctgtcagatctttaatagaaccgagtacgatgtcaggttcataaagacggggctccccgagtttggccgatccagtcagaaccagtacgcttttcattccgtacagcctgcccattgcgatatctgattcgagactgtctccgataatggcgcattctcccggaggaagcccgagcgctttacatgctgcttcagccatcagccaagacggtttgccgatgacaagctccgtttttgctccggcagatgcttcaatggccccgatcattcccgcgacatccatggcatggccgccttcattcggaaaggatctgtcccgattcgtggcgatgatgcgcgcgccggaggaagctgctttaaaagcgagattcagatcctcataggtgacggtttcatgcagggagatgacaagccagtctgccgcctgcggtttttgcgccatggcgacaccagctaaagcgagttcatcagtcagccctttctctcctaacacccacacctttgacaaaggataatgcttctttaaaaatgatgccgtcacactggaggacagcacgatgctccgttcatccgtccggatgccggcaccgagaagtttcttccggcacattgcccttgataaattgccgcggttgcttaaaaagacaacggatttgcccagtgactgaagggtgtgaatggcttctgctgcgccgtcaatcagctcctgccccctgaatacggttccgtctaaatcaatcagaaacccggatgcgtcaagtttggccataataagcattcgccccgtgttttctgtaaaagtgcttatcatgcagcactctgtcgatcggactgagctgtttgttcagcatgagcgaatggtaggccatttccgccactgtttcgagcactacggcgttatgcagggcattcaacgcgtcctttccccagcagaacggaccgtgactgtggacgaggacacccggattttgttcatacggttcattttgaaaggtttcagctatgactttgcctgtatgatattcgtaatcttttacaatctcttcttcatacatttccctcgtgcaaggtatagcgctttcaaaataatccgcgtgagtcgttccgagcgcgggaatgtccctgcctgactgtgcccagctcgtcgcccagcgggaatgtgtatgaacgattccgccgatagccggaaaagctttatacagataaagatgagtcggcgtgtcagaagacggcttcagcgagccttccagaatgtctccgtcctcattcaggacgaccagtttgtctgcggtcagctcactgtaatcgacaccgctcggtttaatgacgattctcccgctctctcggtcgatgccgctgacatttccccatgtaaacgtgacaaggttatgttcctcaagcttcagattggcggcgagcacttcttcttttaacgcttcaagcatagcggctctcccctttcacgaactcacggtttttaatggctttcaggcgtttcatgacattgttttctttgccgaagtagtgaacgagctctttatattccgcatataagctgtcataaatctcagctctttcgcgattcgggacataagaggcgtcttttaatttccccatatgtgcgcaggcttcagcaatattggagaaacctccgttttcccgtcccgcagcgagcgctccgaaaatcgcggaacccagtgcaggcgcctgcggagacccggataatttaatctccatatttgtgatatctgcataaatctgcatgataaaaggatttttttcagcgattcctccggctgcgtaaagctcttcgaccggaacaccgttatcccggaacgtttcgataatcatcctcgttccgaaagccgtcgcttcaatcaatgccctgtagatttcttccggcttcgtgtgcagcgtcatgccaagcatcatacccgtcaaatcggcgtccactaaggttgaccggtttccgttccaccagtcaagcgcgagaaggccgctttcccccggaataagctcagccgcttttaagcttaaaagctcgtgaatgtctatgtgtttatcctccgcttccttctcatagtccctcggaacacacgttttgacaaaccattcaaagtggtcgccgacacaggactgccccgcttcatatcccgcatatccgggcaagatgccgttatttacgactccgcacataccggggacgatatgttcttcctcgccaagcagcacgtgacaggtggacgttcccatgatcatcagcattttccccggttttgtaatgccgaccgccggcactgacacgtgtgcgtcgacattggctacggcaacggccgtccccggcagaagcccggtcagctccgccattttttcggtcagcccgcctgccttttccccgactgaataaatggttccgcttaatttatcctttgtaatcgttttcattaaaggattgagcctttcgaaaaaatgatccggcggataccccgtctcgtcattccagattgctttgtaaccggccgtacagttgcttcgcttcaatgaaccgcacaattgatagacgatccagtctgccgcttccacaatccggtctgccgcctcgtatatatgcggcgcttcttccgcgatttgcatgattttcgggatcatccattcagaagaaatttttccgccgtatcttttgagaaatgtttcatttgtgtcctcggctatacggtttaaacggtccgcatatttttgagccgcatgatgcttccacagcttcacataactgtgaggctcccgttcaaattccggcagcatgcagagcggctgtcccgatccgtctaccggcaagatggtgcaggcggtaaaatcaattcctaagccgatcacgtctttcgggtcagtgcccgtctgctgaagcagactcggaatcgccgttttcagaacttcgatataatcggctggatgctgaagcgcccagtcccgaggaagtttttctcccgtcttcggcagcgtacggtcgatgacggcatgagtgtattcttttacagcggatgcgatttcctcccctgtccggacattgacgagcaccgcgcggcctgacaatgtgccgaaatcgacaccaatcgtatacgccatatcaaatccctcccaaccggtataatacgtcattccatttcagctcttttttcagctcgcgtatttcagtattgcgggaaataaagatgctttcaatgcccgccatctcggcccaatcaagcatctgttcagccgtaagccggaaagacatgcaggtatgatgagcgcctcccgccaaaatccatgcttccgcagctgttttcagcgatggctcaggcttccacagcaaccgcgccacagggagattcggcatgtcgtgatcaatttccctgccttccgcttcattcagaacgagacggaaccgccctccgatatcaatgatgctggcgatgatggctgaaccgccgattccgttaaagaccagccgggcagggtcttctttgcctccgattgagagagggtgtacttcgattttcggctgatcgagagcgactgtcgggcatacttcaagcatatgtgatccgagaatcatcgcacggcccggttcaaaatggtacgtataatcttccatgaaggaggtttgttgtccgtccgccattattttcatcatccgcaccagggcagccgttttccaatcgccttcgcccgcaaatccgtaccctttttccataagacgctgaacggcaagccccggaagctgcttcattccgtgcagcacctcaaaggaagtcgtaaacgccgtatatccgccccgctcaagaaaggctgttaatccgagttcgattttcgcctgttctttaatagaagaaacttttgcttcatcctgtttcgtttcgtcgctgatgacatacaacttgtcgtattcttcataaagcgcttccatttcagcatcagtgacgctgttcatcacttcggtaagatcgccgattccgtatccgtctacctgccagccgaattgaatgtgagcgccgactttgtctccgtcagtaacggctacattccgcatattgtcgccgaaccgggctactttaatatgcctgctttcattccaagcggcagcagtgttcatccattgtgaaatgtcgcgtttgacttcctcatcatcccaatagcccgcaatgatttttctcgtctgccccattcttgactggatatatccgtattcccggtctccgtgagcggattggttgctgttcataaaatccatatcaatcgtttcccacgggatatcgcggtgatattgggtatgcagatgaagcatcggcttttgaaaggcggaaagaccttcaatccacattttcgcgggagaaaatgtatgcatccacgtcacgaccccggcgcagttttcttgatactgtgcttcccgcaaaacctctctgattgtttcagatgacgtgacaaccggtttatgcctgatcttatatcttgatgacaccccgctgagaccgtcacatatcccttttgcatgtttatcgacaagctgaagtgtttcctctccatataagtgctggcttcccgttataaaccaaaattcatattccttgttctgaagcacattcatttccccttcccatcaaaataaggcgctcgcatttaaaaatatacgtacgaatataaaatataaaacttctatccttttatttgtacgaacaacttcattatagttaaggaggaatcaaactgtcaatcttttattgcaagtaaaaagccggaccatatgcccggctgctcaattaataggaaggccagcctgaactccagttgatatcattgatgagcatcttcggaatcccgctgtcttcggcatcatacgcatggcgcactaaaatattcccgttcacaatgtcttgaccgcccgggcctttccagcggtcattgccggaatcaagaattgtgcctccgccttctgacatgcttttcccgcttttatcaagatatgggccggtgatgcttttggatcttccataagcgattttgtacgtactattcacgcctgaacagcatttatcaaatgacaccattaaataatagtagccgttctgataggtgatggccggcgcttccaaagctccgccgttattcggcctggcagcgatggagtaaagtgatcccgtcggtttcattgtgtttttatcaagccttgtcagcttgatgccgctccagaaagaaccgaaagcaagccaagggtttccgtccttatcaattgtcagctccggatcaatcgcattgtaatcatttgcgcttgtcgaacggatgacgagcccttcatccttccagtttcctgagctgagacttgttgatgaagcgagaccgattgcggaggtatttttgccgaatgaagaaacggcataatacagccaatactttccattataatattgaacatcgggagcccattgattcagcccgtaattcggcacgtaattgctccaccatgacagcggggaagtaaagattgatttttgaacggtccatacgccgccgctgccctcctttaagacacgaagcccccgctcaccttccaaaccggttccgaaagcgtaccacgtgtttccttctttcgccatcgtcggatcgtgaagcaattcatttgatgccccccaaaacgcggcagatgccggagatgaagacatcagcagcagcccggctgtaacggctgcgcacgaaaagcggatcaagcgtttgaatctgtttttcatttcataacccctccctttttaagcgcttacaaaatacgttgtcagatttttctgtgtctttcttattgtagccgcagggctcatatttgtacagacaaaaaaaagaatctgcttaaaaaagcagattcttccgtatctttattgatatgtaatacggtcaaccgtttcccggtccaattttttaatcacttctgtgatcagttttaccgtattctcgtaatcatcccgatgcaaaatagcggcatgagtgtggatgtagcgcgttgcgattgtaatggacagcgccggcactccattcgcggttaaatgaatggaacctgaatccgtccctcctccggcaatggaatcgaattgatacgggataccagcttcttccgccgtattcacgacaagatcgcgcaggcctttgtgagataccattgacgcgtcatacagaattatttgcggcccttcaccgattttgctttgcgcctctttttcagaaattcccggtgtatctccggcaattccgacatccacaccgaatgcgatatcaggctggatggtatgcgccgctgttttagctccgcgaagcccgacttcttcctgaaccgttcccacaccgtatacttcattcggatgatcgctgtttttcagattttttaatacatcaatggctatcgcacagccgatgcggttgtcccatgctttcgccaataaatgtttttcattgttcatcactgtaaattcaaaatacggcacaacctggtcccccggaagaacgccccattccatcgcttcttcacggctggatgcgccgatatcgatgaacatctctttaatatcagcggctttttttctggcgtcaggcggtaaaatatgaggcggcttcgaaccgatgatcccagtgatgtcccctttttttgtaacgacggtgacacgctgggccagcattacctgagaccaccagccgccgacggtttgaaaacggaggaaacctttatcagtgatttgcgtcaccataaaaccgacttcgtctaaatgccctgaaatcatgattttcggaccgttttctttgccggtttttttagcgattaggcttcccagccggtctgttgtgacttcatcggcaaatggttctatgtatgatttcatcacttgtcttacttctctctcatttcccggtatcccttttgcgtccgttaacgctttcagcatggtgagcgtttcatctaattttgtcatcaataaacctcctttttttactacccttcttattatacagaaccaatgctgaagcatacgattaattcgcctgaaaaacgggtaaatgttttatatatttctttttaaaaaaatgaaaccttttgttttgtttttcgtattacatcagatcatgacaaaggtgaggaggtgccttcacacatatggccattacagtattcaggattgtcttgcttgcacttcttatttattttatttacatggcggtcaaattctacgcaaatccgaaaagaaagctcagactggcgcagtcaaaagaaaatttttattttattgatgaacagaaaaacacgcgtaaaaatctccagcttacttataaaggagtgctctttgaaggagagaagcatatcccctccaaagatcatccgctgtttattcatacgatattcgtgtggaccgagactccggaaaagctgagcagcttttctgcagatgattatgaagaagtcgagagaaaggtattggagcggtaccccaattgcaagattgattgggaccagcccatcaaaaaagcaaaaaaagcaggcgagcgctgagctctcctgctttttattttttatacatcaaatagatcagcacaagggcgacttcggcgagaaaaagcatcggcaccccgtataaaaaagatttgtgcttcgtcttatgcctgaaggcgcgcatgccgatccatacgccgagcgagccgaacatagcggctgtgagccatatccgcttctctgagattctccacctgcgcgcttttgctcttcttttatcagcgcccataatccaaaagccgtatccgtttatcaataccgcataaatgaagaaagccattgattgtcaccctttacgtaaaaaaccgctccccggaaagagagcggctttttcaacttacttgtctaactgagctttagcagcatcagcaagctgattgaaagcagtaagatcgtttacagcaagatcagcaagcattttacggtttacttcgatacctgaaagcttaagaccgtgcattaaacggctgtaagaaagaccgttcatacgtgcagcagcgttgatacgagtgatccaaagcttacggaaatcacgttttttctgacgacggtcacggaatgcatagtttccagatttcatgacctgctggtttgctactttgtataatgtatgttttgaaccgaaataaccttttgctaatttaagaacctttttacgacgcttacgtgtaacagttccgccttttactcttggcattagatttccctcctaattgttccttgtccgattacttgatgttggcaagctgttgtttaatgcgtttgaagtctcctgcgcttacaatagcacccttgcgaagcttacgcttttgcttttgggatttgttggcgaataagtgacttgtatatgcatgagaacgttttaacttcccagaacctgtctttttaaaacgtttagcagatccgcggtgagttttcatttttggcatgggatttcctccttattgcttttcgtttttcggcgcgagcattaagaacatgctgcggccgtccatttttggttttgtttcgactgtcgcaacttccgcacatgcttcagagaaacggtccaatacgcgctggccgatttctttatgagtgattgcgcgccctttaaagcggatagaagctttcactttatcgcctttttcaaggaatttaatcgcattgcgcaatttcgtgttaaagtcatgctcatcgatcgtcggacttaaccgaacttcttttaagttaatgattttttgattcttacgtgcttctttttcctttttctgctgctcgaatcggaactttccgtagtccatgatacggcagacaggcggttttgcatttgctgcaactaacacaaggtcaagatttgcgcggccggcgatttcaagtgcttcctgacgggacttgatgccgagctgatcgccattttgcccgattaaacggacttcacgtgcacggataccctcattaaccaattgatctttgctaataatgagccacctccatagtttcttcgaattgattcacaacgctttttgactgcattctgcaggcaaacaaaaagtgcgggcatgataacacacccacactacgaacatctgcataaataaaaatgtacggtcaacctgccaactacatgaatgtgtcaatcaggtgagaagcgggtgcctctgcttgtgatttatattcaattcagtaactattctacacaataccggaacattagtcaagaatgacttatccggatcaactttttcattttaacacggtgccggggtaagcgcaaggaaaaatgtgaaattttgttctttgcaacctttgatgtgccggacaataaaaaaaccgggtctatgacccggggcttatccaccgatgagctgaacgaataccggaatgaccagcaccgtcaccactcctacgacgacaaccgcgatacttgccattgccgcttctacctctcccatctcaataccgaccgcaacaccaagtgcgtgacctgatgtgccgagagccagtcctttagagatcgggtgcttcactttaaacatttttaagaacagagcgcccagggcatagacgatcacggcgttgaaaatgacggcgaaagcggtgatgtcggtgatgccgccgatcccttttgacagcggaagggcaattgccgttgtcgccgcctgaggaagcatgcttttcataacggccgcgtcaagctgaatgccttttgcgatcaaatatactatcgtgactgagcagacagagccgacaataattgaagacatgatctgccaccagtattttttcagcttgtcacgctgtttgtataaaggaatggcaaaagcgatcgtcgcgggctccaggaagaacttaataatgtctccgccgcttttataatcttcatatgaaaaaccgccgagcttcagaaaaaggatgccgagcaccatcgcgacaaacagcggggtgaagaggaaaaagcctttcgtttttttaaataaatacgtgccgatgccgaatgctgcaagtgaaacgacaataccgaaatatggactcatctgttttccctcctaatgctgcacaagttcattttcttgattggaacggcgcaccgtttgtttatcagccgaagtttccttctgacgtttttggctgacagacagaatcagctgagaaaaaagacccgtcgcccctaacagaatgatggtggcgagtaagatgacgagtgcgatctgcacgccgtactgctgcatgacgccaagtgaattcatcacggagatgcccgacgggacaaataaaaatccgatcagtgacgttaatgatgttcccagcgtttctacttgttcaagcttaatcactttcagacataagaggacaaataataacaccaaacctactacagaagcgggtataggaatggggacaatcgctgcaatcccattagatatgagcataattacggcaaaaataaatgcttgtgtcagaaatccgtacacttttttcgcactcattttcttcacctctttctctttgttaggtccattataaaagagacaccgatttataaagcgctttcatgacaaacggcagaatattcattctgaaatgcaaaaaacggctgttgaaatgcagaaagccgcctcataaaatatgaagcagcttttttaagtcttttgcgtatgtacggctgacgggaattttagagccgtcttttaaaataagattgtaggtcgaattaaaccacggatgaatctccgtaatatgctccgtattcacgatgaacgcgcggtgcactcgcaagaagcccgtctcaggcagttttttctcaatgaccgccaaggtttcgtgaacggaataagacgcggcgaaagttttgacggaaacgtgtccgtcctccatgccggcaaaaataatgtccttcgtatctaaaataacgatagattcgccggctgataccgccagcttatgcgctccggctgcggacggctgttctgagacggcttctgccctgtcctgtttaacccttttaaactttctgatcgtctggcggactctttcttcatcgaaaggctttgttaaataatcgagcgcatcgacttcaaaggcttttaaagcaaattggtcatacgccgtcgcaaaaacgactgccggcggatttttcatgtttttcagccgtttggcaatgtcaaatccattttctcctgacaaatcaacatctaaaaacagcagatccggtttttgatccatcatgctgtcaaaagcggattcaatattttccgcttcatttatatcacttacttcattcgtccgtttcagcaaataagccaattcatctcttgccagcatttcatcatcaacgattaacaccttcagcatgttcttctccttttgtcatcagtttcaaaggcagctcaaatgatacgtctgtacctttaccggcctcactttccaatcgcagagcggctttgggaccgaacagtccgatcagccgctgatttaaattgtaaagcgcggttcccgttccttctttagacggcagcggacggtttccgagcacagacagcaattccggatcaattccccgcccgttatccccaacccgcattaaaaccgacggaccggcggataccacgctgacattgacggcacagctgtcctgctttcttgaaaacgcatggcggagcgcgttttccacaaggatctgcagcacaaaaggagggatttcgatgtcctccaaaccgttttcgatctcaagactgattttatatttcccgggaaaacgagcctgctccagtgataaatatgcctgcagatggttcagttctttagaaagcgggatgagcagctgcctcgctccctgcagattggaacggaaatagacgctgagctgcagcagaagctttcgggttttttccacatccgtgcggcaaagtgcagaaatcgtattgatcgcattaaacagaaaatgcggattgacctgtgcttgaagcgcctttatttctgcatctttcagtaatttgctctgcagttccgcctcaccgagttcaagctgggtggaaaacagcatggcaagtccttccgcgagctcttcttcaacccggcttaaacccgacgggcttttaaaatacatttttaacgtgccgatcgttttgccgtttgacgtcagcggcaatacgatagccgcatgcagcggacagggatcgtgcgtgcattcaatttcttcctttgatgtcgctttcataatatgtcccgttttgatgacccgttttgacaatccggtgatcaggcttttagacggaatatgatggtcggcacccgccccgacatgcgctaaaatcttttcattatccgtaagtgataccgcatccgtccctgtctgcctgtgaatgatggcagcaacgcttttgcatgagctttcattcagcccttggcggaaaaacggaagtgtctggtcggcaatcatcagcaccctgtgagtttcaagcgctcttgcccgctcttcttttcggataattgactgaatgatggaaagaaaaataaaagtccctgacccgtttaccaatatcatcgggatgccgatgatgctcacaagcgtccaagcgtcagaaaacggcttggccatcaaaaggatgagcagcatttgcaaagattccatcccaagcccgacaagcgcggccacccgcggtgtcggcattgcatagcgttttctgaaataccgcccgatccagccggacaaaacgcccgctaatacggacgagacggcacagctgactgcggtcgcgccgccgagtgataaacgatgcaggccggccaatatgccgactccgatccccacatacggaccgcctaagagtccgccgatttcaacccccataatccgtgtattggcaattgaaccggacggattaatttgaaacacccagtcattattcatgatcatattccgctgaatttctatccccgtatagttactgatgatactgaacagcgagaaaattgaaatcagcaccgcttttcctttatagctctcaggctgctggagcgcctgtctgaacaatctggtatgagccagaacgaatcccaatatgacgataattccgactctttccagcatcataatgatcaaatgcagcatactttttcacctgttctttcaaattttattttatcatgttttaaagcaagagacagaatcggacacaaatctgcctgtttttttcaaatcatcagaaaacaaatctttcacagtctatgtatctattgtagaataaacgggagccttgcggcagagagtttcagaatataacaaagaggagaagatcatgaaagccgtattttttgatttggacgatacactgttatgggatgaaaaaagcgtcagaacaacattcagagaaacatgtttacaagctgaaaaaaaatatggccttgacccgcacacatttgaagaagcggttcgtaaagcggcacgggaattgtatatgtcatacgaaacctatccttatacggtcatgatcggcattaatccgtttgaaggattatgggcgaatttttctgagccggtcagcgaaggatttaaaaagctgaatcagattgcgccggaatacagacgaaacgcctggacgaacgggttaaaaagtgtcggcatagacgatgcggcttacggcgaatatttagcggagtttttcgcggcggaacgcagacagcgcccgtatgtgtatgatgagacgtttgcggtgcttgaaaagctgaaaggcgtttatgaattgcttctgctgacaaacggcgaccccagcctgcagaaagaaaaacttgccggcgttcctgagcttgcgccttattttaatgaaattgtcatctctggcgctttcggaaaagggaaacccgacgcctccatctttgaacattgcctcagtcttctgcacctgaaaaaagaagacgccattatggtcggagacaacctcaatactgatatattgggagcgaaacgggcaggcatcacgactgtctgggtaaaccggacgaataagaaaaatgaaacggacattacgcctgattacgtgatcagcgatcttcacgagctgtttgcgattatagagaaacaaaaacaaagataatcacataccgaaaaaaaccccactcattcagaatggggtttttttatgtttccggattattttttcgcttcggctacagcctttttcacaaaatcgtccagtgaaacggtttcggatttctgctcgccgtatttccggacgtttaccgcgccgttttccgcttcttggtcaccgaccacaagcatgtacgggattttttgcatttgggcttcacggattttatagccgattttctcgtcccggctgtcaagctcgacacgcaggccttcacgctgcaggcgctcctgcacttttttcgcgtagtcaagatgcacagacggtgataccggaatgacttggaattgcaccggcgcaagccatgtcggaagagcgcctttgtgctcttcgattaagaaagcaacgaagcgttccatcgttgaaacgacgccgcggtgaataacgacgggacggtgctgtttgccgtcttccccgacgtaagtgagatcaaagcgttccggaagaaggaagtcaagctgtacggttgacaatgtctcttctttgccgatcgccgtttttacctgcacgtcaagcttagggccgtaaaacgccgcttcgccttccgcttcatagtaatcatggccgatttcatccattgccgccttcagcatggattgcgctttgttccacatgtcatcatcatcaaaatatttttccgtatcttcaggatcgcggtaagacaggcggaaagtgtaatcactcaggccgaaatcttcgtatacgtcttgaatcaaacggaccgtgcggatgaattcttctttaatctgatcagggcggacgaaaatgtgtgcgtcatttaacgtcatgccgcgtacgcgctgaagacctgaaagcgctcctgacatttcatagcggtgcatcgttccgagctcggcaatgcggatcggaagctcgcggtagctgtgaatgtcctgtttgtaaatcatcatatggtgaggacagttcatcggacgaaggacaagcgtttcattgtccatttccatcggcgggaacatgccgtcctgataatgttcccagtgtcctgatgtttcgtacaggtctttgcttccgagaacaggcgtatagacatgctcatagccgaggctcagctctttatccacaatgtagcgctcgatcacgcggcggatcgtcgcgcctttcggcagccagagcggcaggccttgtccgactttttgagagttggcgaacaattttaattctttgcccagttttcggtggtcgcgctctttcgcttcttcaagcatgcgcaaatgctctttcaagtcatcctttttaaagaaggccgtaccgtaaatgcgctgaagcatttggtttttactgtctccgcgccagtacgcgcctgcaaggctgagcagtttaaattctttaatttttcctgtagacggcacgtgcacgccgcggcagaggtcaaaaaactcgccctgctcataaatggagaccgtttcgtcttcagggatggcatccagcagttcaagcttcagattatcgccgatttccgcaaacatggattttgcttcatcacggctcacttcttttcggatgatcggcagattttcaccgacaatgcgtttcatttctttttcaatcttcggaaggtcatccggcgtcagcgcctgctccatttcaacgtcataataaaatccgttttcaatgacgggaccgactccgaatttcacatctttataaatgcgcttaatcgcctgagccaataaatgcgccgtgctgtgccgcatgatgttcaggccttcttctgtgccttctgtaatgatttctacggcaccgtcctcttgaatcggcgttcttaaatcaatttcctgtccgttcagtttaccggctaaagactttttctttaatcccggactgatggatgccgcgatatcttctgttgttgatcctttcggaaattcctttaccgctccgtccggaaatgtgatgttgatcatatctgacatcttcgtcactcctttttttatacaaatcaaaaaccccgccccctatgaaagggacgaggttaaataaacggaatcgtggttccacccttttttccgcgcggccgattttttcggcacctgcggctctaaactctgtaacgggagttcccgtcagctattactggcgcttattcctgcgttcacagctgaagttcaaaggcggtaaagacaatgatccatagctggaaagctttcagcctgggctctcctctcttataaagccggtatcaatgcttcatgtccttatcaatacgtgtagcaatcattaatctgttatgtattataaaatgtctgtgagaaaaatgcaactcggttttccgtctgatttcgcacagacagccccgctgctgccgcaaggccgtctgtgcggctatccttccgtcttctccgacacaaacgcgcctaacgggaagaggcgcaccctctcctgaaacacgttttgaatcgttcttgacatcatatgctccggtttgtccgtatacagttccacggtctcaggcgcaatggagatcagcggcgcaagcagatgggaatcgatatacatcgggtgctcccgcacaaaccgcctgtctatgtattttttctgttcccgttctgacacatagcgcagctcccacagcgtaaaagcccggtcatgtacgatgcggactttcttcatccgcggcggattggatgtcacgtaatctctcagagactggataaagttttgatattcctgttccatccggtattcatctatcgcagcctccgcatattccctgagccgctcataatacttgccgagccggaacgtctgaaacgaacgcacggaaaaaacacccgcatcaagtgaaattgtccggagcgcatctgaaataaactgtgtgcgcggctctttcttcggctcaaacggatgatcatcaagctctccttccataatgctgtgtgcaagctgaaggatttgctgctgttcatcctgatcggtgaagcagtatgcgtcctctatgagcgaaagcatatgctcgtcttctttacattctaaaaaaaacctgacaaatatcggctcaataaaacgctgaacggaaaaagccgattcagacctttcgattccgactttttttatgccttcacggacaataaaatgtctccggtcgtccgattgctgaatgagatgtaaaaaagcagcggtatcgtggtcatcttcaaagatcacttcaagcatatttgtccccccttacggcatctgttacaagtatatgggggatctttttaaaatagacgtaaaggttagctttcaccgccgaacaaatggcgcatcttctttttaaatatgaggggaagcgataaaaacacgatgtaaagacagatcactccgaacatggtcagcacattgccggacataaagctcgcaccgagcacattcaggacaatcgttcccggaatgatgcccgccgcggtcgccaaaagatatgtcatcggcctgactttcgaaaggcccgcggcatagctgatcacatcaaagttaacaggcagaatgcgaaggataaaaatataaaagaagccattggttttcatctgtttttgaatgatttccatttttccgtgacggcttttttctttaaaggcaaacaggcccgccgcaaaaaaagacacggcagcagcgcccattgagcctgccagcgtatacacggtgccgaaaaacggtccgaacgccaatcctccggcgacggaaacgattgatacgggaaacagcacaaaaggccttacgatggaaattccgataaacacaagcggcgcaaaaacaccgaacgataacacccaaagacggatctccttaggcgacagattcagatatttgcggtttgcccacagcaaaaggcccgctcccgccgcagccgcagcccatgtgacagccttcttattcctcattccctcaaatccttcccattggtcgccggcactatgaacggcggcggttttccccgtcaagacggacaggcgaagccaaatataaaatccgctccatcaatcttgccgctttgacttcttctttttctccccgctgtgaataggtaaaatgatgcttcagctcgtcaggtgaaaaattagacgagaagaaagtaggaagctgctggctcattctgtgctgaagcacggtgccgatgacctcatccctgacccagcttgtcattgattccgctccgatgtcatcaagcatcagtacgggcgtcgtttttaccatattcagtttctcctccagcgactgatcctggagcgagtttttcagctctctgacaaattcgggaacatatacgatcattgaggaatactctttttccgcaagctcattggcaatggcggctaaaataaatgtctttccgatgccgaattttccgtacaggtacagccctttgcctttgcccgtctcattatagctcttcagaaaatcagtcacatgctggaaaatgccgagtctgctcggatcggtaatgtcgatctgctgaaaggtcgcgccgagcagatctttctggatatacatgctcttcatcagggatttttgtcttttctggcggtcgagctttctcttttccggacattcgtaatattcaatatcaatcgaacgcccgttgatcacaagcttcggatgatagccttcaagcagactgttcgtctcgttgtcttttgaacagaaggcgcactgcttgctttgctgaacgtattcgtacagtttatttaaccctctgtcaatcatactttgattgattacatcattctgttccttcaaaaaagcctggacgtctttgtcggccatgacctgctgctgcattcgttccaggcgtttttgaaagtcaggtctcttcgttacgccttctaaggatcggctgatcggttccatttcatatcaccccgcttctctgtctcaataggcagagtattttttcagttttttcatttcttccatcatttttttcttctgttcttcaagatcctgtgcggaaagagccggctgttcaggcttattcccgttttcttcttctttcatccaatcagggcgtttttcttcccggacggtttttttgccgcgtgccgcgccgtttgttttgccgtccgcccaatcaagatattgcctatgctcttctattgcgagcttcatagcttcccgcaccgttttgactttctttctggcccagtgggcggcgattttttggatatagtttttggacagcttcatatccgttttcagcatgacataataaatcagcacattggtgacaccgggctcaagtttctgttcgaacataatatccgctatgatctgcaggtcggcttttgacggctcggtcccgtccgcaatgtcctggagcagctttctcggcgaaatggtctcaagctgtgcaatgagttctgtattcaatgaatcttccttttccgccttgttttctctcagacggacaggctgtgttttatcaatcaattccgggagcttcccgcttctttcaatttggtaccagtcgctggccgctttcctcagcgcttcggccgttatcgtatcctgttcattaattgccgtcataacgacgtgctgcatggagataggatctattccgtataaatacgaaagctttttaatactctcccgcacgtcctgtgtgattgatttgcgcggtatcatcgtttctgataatcccgctaaaaacagctcaaaatcaaacacttcctccgtcaccgtataggaaggcgcttgtccgacagacgccgtctcataatcctcggggaggttcatcgcttcttccatatccggcgtcatcttccactcactcggctggaaagaggcaaaggcgtgattaaacggccgcgtaatttcccttgcgccttcgccgacggaaggatgcgtgtaaaattgtctcagctgctggtatttcgttttaccgactctgttataaagaaagacgttcagcatgccgtcttcaaaaaattcattcggtctgagcgggggcagcagctcataaataaacatccgctccttttgctcggactcgcggatatacactttcagcagaccgattccttcaagctttccctgttcatgatgaatcttttttaaatttgactgcatcatacccatcagctgtctgtgcgtggattccgatccccacaaacggttctgctcaagctccccccataaggtcatatacagggagaatgcaaaagaaccgatcagcggctggtacagatgtgtcaaaacctgtctgtcgacatcctgaagaagcgaacggcttttgaccgtataaggatctacaggcaatacgtcattccaatagtcagccatgattctcaaaccttccgatatgtttctactctcattttacaccgtttccgcaatctatcaaatgccaattttgctcatgagaaaagagccagacacaatctcttagctctttagcgttctttctttattaaatctttcaattcatcgataaacacgtttatatccttaaactgccggtagacggaggcaaagcggacataagacacctcatcgattttcgccaggcggtccatcaccatttctccgacgagttcgcttttgacttcagatacgccttggtttcgcagctctttttcaatgtcaaagcacatgtcttccagtgtttttaaaggaacgggtcttttttcacaagctttaattaacccgcgcagcattttttcacggctgaattcttcccggacgccttcttttttcacgacgatcagaggcatctcttcaaacttctcaaatgtagtgaagcggtaatggcaggcttcgcattcccgccttctgcggattgatttcccttcgtccgcaggccgtgaatcaagtacgcgggaaccgttatgctggcatgaaggacatttcaaattggatcagctcccatctgtttcgttgctgtaatgcggttcgcaagcttccggtaaatgcccgccaacgtttctaggatgagcctattgtgttgggagagccgatagaccggccttatctttctctattttacaaaaaaaatgcttaaagaaaaagcaatgctgtttttttacattagaaaaggagcatcagcctcaaagcgcgtaatggctttttcagcttagctcccttgtgtgtgcgttttgaaaattacagtactttcgcttgtgcctgtttaatctgtacaggccccattcctctcggtatttcaatgttttctcttgtatctgcatgtaatgcgtccgcaatgtaatcagcagccacattaggatccaggtctccacaagtataaacatcaatgcttgcatatccgtgttcaggaaaactgtgaatcgttaaatgtgactcagaaataataacgactccgcttacgccttgcggtgcaaatttgtgaaatgcgacctcgcgcacctcagctcctgatttcaaagcagcatttacaaacgttttttcaataaaatccatgtcattgagcttatcaaaatcgcatccccacagctcggagatgacgtgacgccccattgtttccataatcatggaccccccttaacaagaattaaaaaagtgaatttccgagaactgacccggctatttaccacgggggaaagttagtccggagaggtcctaaccctttaagtaattccgaagcagtcacgagcaagaagttcacgaaagatagtatactgtgtttaagtttattttgcaagaagtgttttttgcgaatatgccgttaagggttttttctaacaaatgtccatgatctttattctacacagctgacgggtgtttcattcgcgcggccacgtgacggataagatcaacgacccggcaggaatatccccattcattgtcataccaggcgagcacctttacttttcggtcttccatcaccattgttgtcagtccgtcaatgatcgcggaatgtgaattcgtattataatccgaagacacgagcggctcatccgaataatcaagaattccgtacattgacgtctttgcggctctttggaaagcggcattcacttgctcggccgacacatctgttttcagatcgcagacgaggtccactaatgacacattgggaacgggaacccgtaaagcaaggccgtgaagttttcctttcagatgagggagcacgagcgacagcgcttttgcggcgcctgtagaagtcggaatgatggattctccgcacgctctcgcccgcctcagatctttatgcgggttgtcgatatttttttggtcattcgtataagcgtgaacagtcgtcatcaggccgctttcaattccgaattcctgatcgagcactttgacaaccggcgcgagacagtttgtcgtgcaggatgcatttgaaataatgacatgttcatccggattgaattgctcttcattgactcccatgacaatggtaacgtcttcatttttgcccggagcggttaaaatgaccttcttcgcccctgcttcaatatggctcatggctttttcttttgaattaaattttcccgttgcctctacgacgatgtctattccgcactctttccacggaagctctctcggatcccgccgattgaacagcataatatgtttaccgttgacgatcagactgtcttcggcggcctcgacttcttgatcgtatctgccgtggattgtgtcatactttatcaaatgagcaagcgtttccgggggatagcttgcattaatggctgttatttgaatttgatcatcttccattgcttttctgaacaccattcttccgattcttccaaacccgttgattgctacttttaccttcatgctcaggtcacccctttttaatatgccactctaattaatttttaattatatatagtataacacattaaaagaaatccgccagtacaacttgataaaaatccacccttataccgatcaatatgttgttcaatcggtttttttgcatataaaatgatcttttttccataaaaaaagcaggatcagcgtctcatcctgcctgcttttttcttatatttgttccggatctttaaatttgtcatttaaaatgctgtcctctaaaacggaagacacctcgccgtaccgtttagaaatatgcatcgcgccccagtcgcacagcgcgtttaaaattctttccagactgtgcccgtattcactcagctcgtattcgactttcggcggcacctgattgtacacgatccggttgatgacgccgtctgcttccagttcccgcaattgctgtgtcagcatcttctgggtaatctccggcataagccgcttcaattcacttgtccgctttttcccgcgcatgaggtggcagaggatcacacacttccattttccgccgatcacttcaagcgtcgcctctacggatatattgtattttttcttcagcaacggtaattcctcctcatctataggaactaaaaagtgcctatggcacttaaaagtacgttcttttcaatgacgcttctatcaatcataatgacatttgccggatgaaaagggatgtactcttatacttatatcgtttacccggcatcatttcaaccatacattatcgaccaaggaggaaaacagatgtcttcacatcgccaaagctatttaccagcgctgctggcattagccgtcagcgcttttgcgatcggcacaaccgaatttatcagcgtcggattgctgccgcttatatctcaggatctgcatatacccgtgacaacggcgggccttaccgtttccatgtatgctctcggcgtgacattcggcgcgccggttttaacttctctcacatccggcatgtcgcggaaaacgctgctgctctgggtcatgttgatttttatcgccggaaatatactcgcggcgagcgcgtcttcaatcggaatcttattgacagcgcgggtcattacggcgttttcccacggcattttcatgtcaatcggggcaacaatcgccgccagtatcgtaccggaacataaaagagcaagcgcgatttccattatgtttacggggctgacggtggctacggtgaccggcgttccgttcggcacctatctcggccagcaattcggctggaggattgcgtttgccgtcattgtcacggtaggaatcattgccttccttacaaatgcgcttctcgttccgtcaaatttgcgtaaagggacgaagaccgcgttttccgagcaggtaaaactcgtcacgaacggacggttattgcttttatttatgattacggcgttaggctacggcggaacgtttgtcgtgtttacgtatttatccccgcttcttcaggaagtaaccggctttcagaaagaaaccgtcgcagccgtcctgcttgtttacggaattgcaatcgccatcggaaatatgattggcggccgattatcaaatcgaaatccgctgaaagcattgctttacatgttcattgtccaggcagctgtgctgtttgtcttgacttttaccgcgccgtttaaaacagccgggctgatcaccattattttaatggggctgttggcgtttatgaatgtgccgggactgcaggtatatattgtgatgctcagtgaacgttttgccccaagcgccgttgatacagcatcagcattaaacatcgcggcatttaatgccggaatcgcgatcggctcgtttgccggcggagtcattacagactcaatcgggatcattcataccgcttggatcggggcgctcatggtgctcagcgcggtcgtgttaaccggatggagcaggaagcttgaaaagcgggatcacatcatccctgaaaggaggtgagtttttcttcaggcattttgatcttttcaacaaacaaataattggaggaacatatacatgacaacacatttacaagcaaaagcaacattgcataacggagtaaaaatgccttggtttggcatcggggtgttcaaagtggaggaaggcgcagaactcgtcaatgcggtgaaaacggcattggtgcacggctatcgcagtgttgataccgccgcgatttacggtaatgaagagggtgtcggtgaaggcatccgccaaggattgcaagaagcgggattaaaacgtgaagacatttttgtcacgtcaaaagtatggaatgccgatttaggatatgaagaaacgttaaaagcgtttgacatgagcttagagaaactcggtttagactatttagatttatatttgatccattggcctgtcgaaggaaagtacattgatgcgtggcgggcgctcgaaaccctctaccgcaatggacgcattaaagcgatcggggtcagcaatttccaaattcaccatctgaaacatcttatgaaagaaacggatattaagccgatgatcaaccaggtggaataccacccgcgcctgacacagaaagaactgcaggcattctgcgccgaacaaggcattcagcttgaagcgtggtcgccattgatgcaaggccagctgcttgatcatcccgtcttacaggagatcgctcagaagtacggcaaatcagcggctcaagtgattttgcgctgggatttgcaaaacggtgtcattaccattccgaaatcaactaaaaaacaccgtattgaagaaaatgcaaatgtctttgatttcgaactgtcagctgaagatatgaaacggattgatgatctgaacgaaaatctccgtgtcggtccggaccctgacaattttgatttttaatccagaaaaacaccgttcggcttcccgaacggtgtttgtttatgcccagctgctcaatatttcctccagctgatgctttgtatgttcaagactgccgctgttatcaatgacggcgtcagctttttttgttttgtccgctaaaggcatctgcgacgttatccggctcatcgcttcttcttctgtaagagaattccgctccatcagccgtttgagctgtatgtctgccggtacggtgacgacgagcactttgccgacaagatagtcaagcccgctctcatacaaaagcggtatatctaaaacgacgaactgctcttttcgcgcaacagcctcatcccgctgtttcatcatttccgcacgcaccgccggatgaacgatctgattcagcgtcagacgcttctgttcgtccgtaaaaacgatggcaccgagtttttttctgtcaatcccgccgttttccagcaggatttcttttccgaacgcttcaacgatctgtccgtaagccggctttcctttttccaccgcctgttttgcgatgacatccgcatcaatgactgtaatctttttgtcgatcagcatgcgcgctactgtgcttttgccgctggcgatgcctcccgttaaaccgatgaccaagctcaaaaagcccactccttctacattttccaaatcccgatgataatcagcaggactcccggcaaaaatgtcattttatctatccaattccatcttgaaaagaaatgccccgcgtttatgccgagtgaaacaaacagcgagctcatcaccccgacggtcacgctcatcataaccggagaaaagccgagaatggctgctcccatgccggcgccaaacgcgtcgattgataaggcgataccgagcaaaagcgcctcgactccgttaatggttccggattgatcaatatcagcgctggtcggctttttcaaaatgtgaatcacgatgccgagcgatttcacttcaagattaagtaacgttttttcatgcaataagtaatccggctctttagccggtttaaaaaattgatagatgacccatgccccgattccgattaagatcagcccgcccagtttctccgtgacggatacgggaaaaatctttgtcagaaaatggccgatcagcatggatataaacatcacagaggctgaacagcaagcgatcacggcaatcgctttgaacgggattttcatttttctcaatccgtacgtaaacccgactgaaaaactgtccaagctgacagcaaaagccaaaagcagcaaagaaacaatctccatatccgtttctccctttctcttgatcggcaattgtgacaaatgcctattgggtgaatcacaatatatatatggagaaaggtcatcaactgtgttagaaaaaagtcattcttccggcgtccgcttgaacagcttcagtttatgattttttttggcatcgggcgcagaaatgcgtacctcttccgccgaccacgattttagaaatcatcgtgccgcacgtcttgcacggctcatcttttttgccgtatacgtaatgtctgagctgaaacattccgatctctccttgggaattgatataagaccggacggtgctcccgcccgcgtcaatcgcttcctgaagggtgtctttaatttctgtatggagcttttttatctgcccgtctgacagactgttcgcttttgtctcaggatgaatccccgcccggaataaagcttcatcgacataaatgttgccgaggccgacgaccgctttttgatcgagcagagcggttttcaccgcgcggttcgttttggcgagccgctcttttaaataggcggcggtaaatgcttcatcgtcaggctcaggcccgagctgtgaaagcggtaatgcagtcagttcctctcccggcgcaaataaatgcatcgtgccgaatttccggacgtcccggtagcggagctgtgttccgtccgtcatgttaaatacgacgtgcacatgtttatcgtcaggctcatcggcctggtgaagaccgtatttcccctccatccggagatgggagaccatgacataatgatccagatggaaaagcaaaaactttccccttctcccgatggatcggattgtttctcctgcaatctgccgcgcgaattcctccggctcggcgggttttttgatgatattcggccatctgatgtcggccgattcaatcgttttccctttcacaagaccggtcagagtgcgccggaccgtttcaacttctggtagttccggcacaatcatcacttcctttttttctgtttattttgcatcgtaccaagacgggcctgaagcataatccgcctttaacggcacgtctaaatccaaagcatgttccatcacttcaggaaccagcttctctaatattttaatttcttccttaggcgcttcaaaaatcaattcatcgtgcacctgcagcagcagtcttgccttcagatttttctctttcagctcagctgccatatcaatcatggcttttttaataatatcggcggcgctgccctgaatcggcgtattcatggccgtgcgttccgcaaagctccgcaggttgaagttgcggctggtcagctcagggatataacggcggcgctgcatgagtgtcgtaacatatcctttttgcttcgcttcctgcaccgattcttccatatacgccttgacacccgggaagctctccaggtagcggtcaataaaagcgcccgcttctttccgggtaatgccgaggttttgcgacagaccgtaatcactgatgccgtaaacgatgccgaaattgacagcctttgcctggcggcgcatcgcttgtgtcacttcatcttcactgacatgaaacacatccattgcggtttttgtatgaatatccatgtcattcgtaaacgcctcaatcagattttcatctttagaaatgtgcgcaagcaccctcaattcaatttgtgagtagtcggcggcaaaaataagccagtccggttctgacggaacgaatgcctgacggattttgcgcccttcctccagccggatcggaatgttttgcaggttcggatccgttgagctgaggcgcccggtttgagtcaatgcctgattgaatcgtgtatgcaccttatgagaatccttgcgcgtgactttcagcagcccttctatataggtcgattgaagtttgccgatttgtctgtattgcagaatataagcgacgatatcatgtttgtcggcaagcttctccagcacatcggctgaagtggaatagcctgtttttgttttcttcactaccggcaggccgagcttgtcaaacaaaatgacgccgagctgttttggtgaattgatgttaaacggttcaccggcgatgtcatggattttttcttcatattctttcagtttcgcgcggagctcttcacccattcgcttcagtctttcaacatccactttaacgcccatagattccatttctccgagaatcagcgcaagcgggagttcgagatcttcatacagttcaagctgattattttctttgagcgcgtgcagcagcttatcccggaggctgttaacggcagccgcttttcgcgcgagatggtcggcaagctctttttcagccggaacggcgtgctttgcgccctttccgtaaaccgcttcgtctttggaaacgatattcagcccgtattctttcgcaacgctcgcgacatcgtcgtacgaattgcccgggttaataatgtaggccgcgagaagcgcgtcaaattccgttcccttcagctcaattccctgccagcgcagagcgacgacggagcgtttactgtcaaacacccactttttcttcgactcatcttcagcccaggatttaaacgcttcggactgaatggctgtttctttcggaatataataaaggcctgtttcattcacgatggaaaagccgagaatcggttcttcatgatagttatcaccgatttgttcgacgactaaagcggacggcgaaacgagcatgtcttcggtgatttcttcaaccgtttcaacatcgatgtcctcaaagtcttcttccgcagtttctccgctttcttcaccgagccgttcaagaagcgtgttaaaaccgaggtctttaaatatggcgacaacttgttcacggtcaaacccttgataatctaaatcttcgagcttgacttcaatcggcgcatttgtcataatcgtcgccagctctttgctcatcaaggcttgttctttatattccccgagcttttcttttaatttttttccgctgacttcatcaattgaatcaagcagtttctcaacggaatggaactgctttaagagcttaatcgcggttttttctcccacgccgggaacgcccggtatgttatcggatgaatcccccattaatcccttcatatcaataatttgcagaggtgtcagaccatacttttcttcgacgtgctccggcgtgtaatcttccacgtcggtaatgccttttctcgtaatggcaacggtcgtttttccggtggcaagctgcgttaagtctttgtctccggaaaatacctttacttcgaagccgtctttttcagcagatacggcaagcgtgccgataatatcatccgcttcgtattcaggaagctcatagcggctgatgttgtatgcatcaaggagctcgcggatgaacggcatctgttctgaaagctccggcggcgttttttgtcttccgcctttatattctttaaacgtgctgtggcggaaagtcgtttttcccgcgtcaaaagccaccagcatgtgggtcggtttttcatcctccagcattttcattaaaatcatagcaaagccgtatacggcatttgtatgaatgcctttttcattgcttaaaagcggcaatgcaaaaaacgcccggtacgccagactgtttccgtcgacaagcactaatttttttcgttccgtcattcaatatcctcctaagagcaaaagctcgtgattcctctggttttaatctcacagcttctcttattttaacaaagttcaatttgaaaggaaaatgagcgaaccccgagaaaacgcaaaaaaggacgggaacaaggaaacacgttcccgccgtcaaaattggctccttggatgaaggggttctgttacatcctaacaagataggtttaacaggtcatgaagaaaatgttaatcctttgtaaagctgatcacgcttccggcggccgcttcagcgtcacggtaaacacagtcccctgtcccggctcgcttgtgacctcgatatggccttcatgggcttctattaagtgcttcacgatggcgaggccgagccccgttccgccagagttgcggcttctgtctttatccacacggtagaatctctcaaatatccgcggaatctcttccttctgaatgccgattcccgtatcggacactttgatatcgacaacggtttctttcacgtttaccgaaattcccaccgtccctttttcaggggtataggttaaagcattgttcgccaaattcagaaatacctgcttcagcctgtgcgcatcacccgtcacaaaaatcggctcttccgggaggtcgagctgaaagctgatgcctttttccgcagccttatgctgcaaaagcgcttcaatttcatgcagaatttttgcggcgtcaaaggattctacacgcatcgtaaagttttgctgttccattttggataaatccaataaatcctgcacgagcgattggagccgttcactttctttcagaatgatagaaagaaagtctgaaagcgccttatcgtctttcattgccccgtctaacagcgtttccgtaaagcctttaatggaggtgatcggcgttttcagttcatgggagacattggcgacgaagtcctttcttatctgctccaattttttaatttccgtcatatcgtgaaagacgagaacgatgcccttccattcatcatcaggacccatgatcggaacgccgtcaacttcaaagtaccgccgttcaatgttgatgggcagtctgagcagctggcattttttcgtctccgtcataaatatatcttcgacaagccgaatgatttcctcatgctcaaacgcatcatgataaaggcggcgaagcagacgttcaggctttgtatgaaactgcttcgtgtacgaccggttcacgagattaataaagcctcttccgtctattaaaatcaaaccggaaccgatattttcaatgacggttaacagacggtcgcgctgcatatcctgcgttctcgtcatttccatcagatcgaccgccagactgttcatcgcacgcccgagacggtccgaccgccttgcgtaaccgctgtaggagcgggcgtcataattccctttggacagctccgtcgccacttttgtcgcggcgtcgattgattttttgtaacgggacgtcatgtttgtataaaagaaaacgataatgataaaagcggtacaaagacttgccgccagcatgccccacatttctccggtgatgcttgaaccgccgttgatctccgaagaaacgactacatatcccgccgtttgcccggtgtcatttttcacggcagtcccacggatcactttgcttcccgcctgtatggccgcctcatttttattgtgagacatgaactcctttacggctgaatcatcggcatgactgccggaatgatatacggtgtcacccttctcattaagcacggagacgtttataccgagggtgcggccggcgtcgtgaatcaccgtgtcattgcttttattgccgattcggccggtgtcaagaaggcccgctatgtataccgcttccttttttagctgatccgccgttctttctttagcagatgaagaaataagctgctgtagaaaaaggccgagaacactgaaaaccaatatgatacatacaacgagtaaagcgaacagacgcacacggactttattcattcatttttggctcctccagtttataccccaaacctctgattgttttaatataaatgggttttttggtatttgattcgattttgtcgcgcaaatggctgatatgaacgtcgacaatccgggtatccccggcaaaatcatagttccagaccgcgctcagcagaagatccctcgtcagcactcttcccttgtgttttcctaaatacagaagcagttcaaattctttaggcgtcaattccagctgttctgacttgaagtacgcttcgtaatgctccggaagaattttcagctcgccgatgaggatcttcccgtccttttcctcttctctgccttgtgacagtgaagaaatgtcagcccttcttaaaatggcttttacccgcgcagtgacttcccgcggactgaatggctttgtcatgtaatcatccgctccgagctcaagtcccagcaccttatcaaactcctcatcttttgctgtcagcatcaagatcggaaccatcattttctgctgtctgagctgtttacagacgtcgattccgtccactttcggcagcatgacatccaatacgattaaatccggattttctttctctgcctgttccagagcctcttctccgtctgatgcggtaatgacatcatagccggacctttccagattatactgtaaaagagtaacgatagattgttcatcatctacaactaaaatttttttgttcatgctgcgccctccgctgtctattttccccgacatccaattttctctattttatgtgttgcatatcactttatgatttcattttatccaatactgcccgttcagacaattcgcctttttgatcattttcagagaaaggatcgttcagggaaaaagaaaacgctttcattaattgtaaaaagaggaaggcttctgattcggaagccttcccttttttcttatgacaatactttcatcacgtttttgacagattcaactgatttactcagctgcgctttttcatagtctgtcagttcaagctcgatgatttgctctaggccgtttcctccgataatcgtcggtacgcctaagtaaatgccttcatgaccgtattcgccttctaagtaagcgatggtcggaagcacgcggcgctgatctttcaaaatggcttctaccatttcagtcagtgatgcagcaggcgcgtagtaggcgcttccgtttccgagaaggttgacgatttccccgccgccttttcttgtgcgttctacaatcgcatcaagacggtctttcgggataagcgtttcaagcggaatgccgcccgcataggaataacggacgagcggaaccatgtcgtcaccgtgtccgccaagaacaaagccggtcacatcttttactgacaggtttaattcttcagcgacgaacgttctgaatcgcgcagtgtcaagcactccggattggccgatgacgcgctctttcgggaagcctgattctttgtacaccgcatatgtcatcgcatcaacagggtttgttaatacaacgatgatgcagtcaggagaatatttcacgatttcacgtgtgacgcttctcatgattttttcgtttgtagatacgagatcatcacggctcatgcctggttttctggcaattccggcagtgataacgacgatatcagaaccggctgtgtcctcgtagttggacgtacctgtgattttcgcgtcaaatccttgaaccggacttgcttcgagcatgtcaagcgcttttccttttgtcgggttttctaattgcggaatatcaacgagcacaacatccgcaagctctttttgagctgtaagaaaggctgttgtcgctcccgtaaatcctgctccgataacagaaactttactgcgtgtttttcccatgattctcttctcctttttttggcttcattagaagtctgctttaggttcagtccatgtttttgatgagctcttcaccgaactctgaacatttcacttcggttgcaccgtccattaatctagcaaaatcgtacgttactacttttgaagcaatcgttttttccatagatttaatgatcaagtcagcagcctcattccagttcaggtgttcaagaagaagcactcctgaaaggatgacggatgacgggttgaccttgtcaaggccggcatatttaggagccgttccgtgagtcgcttcgaaaatcgcatgccctgtttcatagttgatgttcgctcccggcgcgattccgattccgcctacctgagcggcaagcgcatcagagatatagtctccgtttaagttcattgtcgccacgacgtcgaattcgctcgggcgggttaagatctgctgaaggaaaatatcagcgatgctgtctttgacgatgattttccctgctgcttccgcttcgctctgcgctttatcagctgcttctttcccgtctttttcgacaatgcggtcatattcagcccaagtgaatactttatctccgtattctctttcagcaagctcgtagccccagtttttaaatgccccttcagtgaacttcatgatgtttcctttgtggacaagtgtaacagatttacggccgttttcgatcgcatactcaatggcggctctgactaagcggcttgttccttcttcagaaacaggcttgattccgattcctgatgtttcagggaaacggattttgttaacgcccatttcattttgcaggaagctgatcagcttttcaacttcttcagaacctttcgcatactcaattccggcgtaaatatcttctgtattttcgcggaaaatgaccatatctgtatcttcagggcgtttgaccggagaaggcactcctgtgaaatatctgacagggcgcagacacgtaaacaaatcaagctcctgtctcagcgctacgttcaaagaacggataccgccgccgacaggtgtcgtcagaggccctttgatcgcgatgaagtactctctgatgtcttccagcgtttgggcagggagccattcacctgttttattataagccttttcaccggcataaacttctttccacgtgatttttttctcgcctttatatgctttttcaacagcagcttccaaaactttagaagcggcattccaaatatcagggcctgtgccgtcgccttcaataaacgggatgatcggattatttggtacgtttaatactccattagagactgtaattttttcaccttgtgacacaatattacctcccagtatgtaattcatatttagaaaacattttatttttcttgtataaaaaataaaatgatttttctcaagattctatcaaaattgtaaaccaacccgggcttgattaacaagaggctaacgacatgaaaatcaccagcctcccgtttgatcaggctctttcatcaatcggaacaaaagtctgcttatccggacccgtgtattcagcgcgcgggcggatgaggcggttgttatcgtattgctcaagaatgtgcgcgatccatcctgacattctgctgaccgcaaagatcggcgtgaacagatcgtgatcaatgccgagactgtggtagacagatgcggaatagaaatcaacgttaggcggaagttttttctccgacgtcacgatttcttcgacacggattgacatgtcgtaccatttgctttcacccgtcagattcgtcaggcgtttgctcatttcttttaaatgtttggcgcgcgggtccccatgcttatacacgcggtgcccaaagcccattactttttcctttttctccattttgctgcggatataaggctcggcattttccacttcgccgatttctgtcagcattttcatgacggcttcattggctcccccgtgaagcggcccttttaaagcgccgatggcggctgtgatgcctgagtaaatatcggataaggtggcgacgcatactctcgccgtaaatgttgatgcattcagctcatgatccgcatgaagaatgagcgctttgttaaacgcttccacttcgatcggagaaggctcttcaccgtttaaagtgtataggaaattctccgcgattccgtactcttccttcggttcaacgggatcaagccctttacggattcttgagaaagcggcgacaatgcccggcaccttcgcctgcaggcggatggcttttctgtagttcgcttccggattcatgacatcggcttcactgtcagtcagaccgagtaatgaaatcgctgtccgaagcgccgccattggatgtacgttattgaggggataggatttgaagtgctcaatgatttcttgtggaacggcagcttctttcgcaagctgttttttcaattcagcaagttccgttttattcggcaggcgcagatgccacagcaaataaatgatttcttcaaaacttgcattctctgtcaagtcgtcaatatcgtaccctacatatgtaagggtatcgtcgataatagagcttacagatgatgttgttgctacaaccccttcaagaccgcgtgttgctgtcatattcaacctctccttttcaatcaaaattcccctttaaagagtatataaaacatacggcttacttaaaatgagtcatgcaaacaatccctttcccctttaagaaaatgcttacatttcactggttgcggttacataaccgatatgcttatagaggaacataacaaattcttataagcttatttaagtttaagcctattcttattataaacaataatcagacatttgttaaatgtttacctataatttttttttctttctcgcacattttcttgattttacgcggttttttcatctttttccgcaaaaaaaaagcagctttcagccgcttttttactttacgaagtgaatattttaacgatttgcatggccaagtaggcgattccggcgccgattaacggaccgacggcgacgcctccgaaaagcgcgacggcaagtatcgtgccgatgaccagcgccgttgtaatatgaggatcgttttccaatagggtgagaccgtttttggcgattaaggcaacggcgatcccggcaccgagcgcgatccacgcgtaatacgatttcatcgcttctccgagctgtttaaaaccgatatcacccgtagcaatcggcactaaaacggcgattgtaatgacagtaaccccccagttgattccttttgactgaataaccggaaacagtttctggtcaagaccgacagcttttatcacgataagaaagccgacggcaaaaagcaatgactgatttttggctatcaatgcgatggccagcaataatagtaaaaataaattcgcctgtgtaaacatcctgaaagcaccatcctttatcataactgtattcatatccttttttttgacgaataaactaatgtaataggacgtgccgaccgagaggaggatcgatgtgaatccgcactatgcaactgtttttttccgcgcgctgtttgtactcgctgcggccggcggcgctttagcggccggttacgcctcattcccgttaacttatccgtttctgatcgcccttattctgtcatcggcgatcataccggttgttgactggctggacaaactgacgggtctgccccggtcagtcaatacagtcattgtcctggtcttctttttgctgatccttcttggcgcggcgacctttctggttgcggaaatcatttcgggaaccgcttatctggctaaaacgctccctccccatatcagcgcctttatgacatattgcgaagagctgttcacttcccgcattcagccattgtaccacgagctgaccgtcttatttaacgggctggaaaccaatcagcaggcatcaatcgtgacgcatatccagacgctcggtgatacagccgctaaaaatgcggggctgatgctttcacatcttttggaactggtgccgaaatggattgccttccttcccaatacagcagccgtcttcgttttcgcaatgctggccaccttttttatgacaaaggactggcacaagctgaaagcgctgctttattccattcttccggaacgggtttcggcaaacgccaaggccgtatcgggagagctgaaaaaagcgatggcaggtttcattaaggcgcaggccgtgctcatcctttttacgatgatcattgtctttatcggactttttcttttagggattgagcatgcggcaaccattgccttttttatcggactggtggatcttctcccgtatctcggcgccggatcggtatttgttccttggattatgtatttggccattgccggacagcttcctcaagcgatcggcctcggtattttatatattgtggttctcattcagcgccagctgacggagccgaaaattctaagcaagtcgatcggtcttgatccgcttgcgaccttaatcgccctgtttgccggctttaagctgttcggaattttaggactggctgcggggcctgcactgcttgttttcattcaggcatttatcacaacgggcgctttaaaagaaatatgggcctatattactgttcagtccaaataaaaacagcagccctgtaaaaaggctgccgtttttatttgataatgatccgcttgttttttgacattcctctcagccatttgaacaaaagcggcttcatgcggttccgagtgaacggaatcagaagacaggcccctgcaatatcggacaaaaaacccggaagcatcaaaagcaggcctccgataaagacgcatatcccgtccagaagcgcttcccccggcattttgccgtgctgcagatcgcgcatcacccgatgatacacatcagttccctgtctttttgccaccaaggcgcctaacacacctgtcaaaatgatgagaaggacggtcggaaaaacgccgagccattttcccgccagcagaaacaagccgatttcaatcgccggacacacgataaacagtaagaataaaactctcatttttctgccctcctgcccttctaaaaagcgtgtcaccgcccgcatgggaataggaaaatcagcctaaagacaaaagagaagggcaaatcccctctcttttttaaagctgtttaaagaacgcttgcgcggccttcatacacagcgccgcgggcagcgtcaactgtgataacctgtccttctgttaaaactgaagttgcgttctccaggcctacgataaccggaatgcccaagcttaaaccgaccacggcagcatggcttgtcagaccgccttcttcagtgatgagcgcggatgctttttcaagtgaagcgatcatgtcgcggtcagtgcttgagacaaccaataccgcgccgtctgtcattttttgttcagcttctttcgcattttttgcaactacgacaggaccgaaagcggatttgcgtccgatgccctgcccttttgcgacaatgctgccgacagtgtggactttcatcagattcgtcgtgcctgattcaccgacagaaccggctgtaatgacaatcagatcaccgcgtttcacgatgccgctgtcaagtgatttttgtaccgcatcttcaagcatttcatctgttgaatttgcgttttgtccgcttgctgggaatacaccgaatacaagaccgagtttgcgtgatacagactcgttcaccgtaacggctacaatcggagcctgaggacggtatttcgcgatcatacgcgccgtatggccgctttctgtaggcgtaacgatagctgctgcattcaggttgatcgccgtatgcgcaactgattggccgatcgcatcggtaatcgtcatgccgacctgatctctgcgtttagacagaatttctttgtagttcagagattcttccgtgcgtgtggcgatgttaaacattgtttgaaccgcctcaacaggatattgtcccgcagctgtttcaccggaaagcatgatagcatctgtgccgtcgaaaatggcgttggcaacgtcacttgcttcagcgcgtgtcggacgagggttgcgctgcatgctgtcaagcatttgtgtcgcagtgataaccggtttgccgagcgcgttgcattttttgatcatttctttttgcacgagcggcacttcttcagccggaatctcaacgccgaggtctccgcgcgctaccattaagccgtcagaaacttccaggatcgcatccaggttgtccacgccttcctggttctcgattttagggatgatttgaatgtcagacgcgttgtgctcttcaagcagttcgcggatttccaggacatccgtagaacggcgcacaaatgacgcagcgatgaaatctacgccttgctcaataccgaatacgatatctttggcgtctttttcagtaattcccggaaggttgacgctgacacccggaacgtttacgccttttttatttttcagcgtgccgctgtttaagatttttgttttgatttcgtgtttttccggatttgattcaagcacttccaatccgattaaaccgtcatccaacaggatgatagatcctgctgacacgtcgtctgccaggccttcataagaaacagagaacttttcaagtgttcccagcacctgtttcgtagaaacgataatttcatttcccgcctgaagctcaagctcgccgttttccatatcgtgcgtgcggatttccgggcctttcgtatcaagaagaattcccacgtttttgccgagctttttgcttgcttctctgatgtttttgattcttgcgccgtgctcttcgaaatcaccgtgtgaaaaattcagacgagcaacgttcatacccgcttccatcaactttgtcagcatttctacactttcactggccggaccgattgtacaaacgatttttgtttttttcaactcgttcacttccttctgaaatcttcagcttctaccgtcttaaatagacagttcttttgaaagctgatacatgtttggttcaacagtatgttttgtctctaaaatttctataatatcatggtctacaagcttgttgttttgtatacctacgcagcgtccgccttttccttcaagcagaagctcaaccgcgtaagcgccgaggcggcttgcaagaacccggtcagaagcgcttggagatccgccgcgctggatgtgccctaaaacggatacccgtgtttcaaggttcgtctcttcttcgatgcgttttccgaattcaaccccgctgcctaccccttctgcaacgatgatgatactgtgttttttgccgcggtcatgccctctcttcaaacggccgataatttcctccatatcgtaatccgcttcaggaattaaaattgattccgctccgcctgcaagccctgcccataaagcaatgtcgcctgcatggcgccccataacttcaataacgtatgtacgctcatgcgacgtagcggtgtcacggattttatcaatcgcatcaattacggtgtttaacgccgtatcaaatccgatcgtaaaatcagttcccgggatgtcattatctatcgtacccggtacacctacacatggaaacccgtgttccgttaattttttcgcacccatgtatgaaccgtctccgccgataacgacaagaccttcgatgccgagtttctttaaattttcgattcctttttcacggccttcaactgttttgaattcaggacatctggccgtgtacagctttgttcctccgcgatggatgatgtcgccgaccgaacccagctccagtttctctatttttccgctgattaatcctgaataaccgttataaattccgtatacttctacatcgtggtagatagctttccgcacaaccgcgcgcaccgctgcgttcatccccggggaatccccgccgctcgttaatactcctatacgcttcattttcctattcacctcagcaacatatatatgttaaacatatcatgatcattgccctaaaacaatgaaaagggacgcctgagctcccatgaaaccttacctattatacaattaaataaattgtttttaaataaaatttaaggaatatcacaaaaaacacaaaaaacacaaaaaataaacgtgagccataggcttcacgtctattcagtttaccccgatatattgatcctcaaccgaaacttttccgattgctttatatttttcgtagcgctgtgagatcaattcttcggcgttcaattgaagaagagattttaatgtttctttaagaatgccgtcaatgtagcccgcctgctgcttgatatcatggtgagctccgcccttcacttctttaatcatatcatctataattcctaattctaataaatcgggcgcagtaatcttcatggtttcagccgcttttttggcaaggctggaatctttccacaaaatggacgcggctccttcaggagaaataacggaatacgtcgagttctcaagcatcagcatgcggttgccgacacctaatgcaagcgcgcctccgctgccgccttccccgatgacgatacaaacgacaggcactgtcaggccggccatttcgaacaggttcttggcgatggcttcactttgtccccgttcttccgccgctttgcccggatacgctcccttcgtgtcgatgaagcagataatcgggcggttaaacttatccgcctgcttcatgaggcggagcgctttacggtagccctccggatgaggcatcccgaaattgcggacaaggttttctttcgtgtcttttccgcgctgatgaccgataacggtgaccggcatgccgtgatatttggcaactccgccgacaatcgccgcatcgtctccgtacgttctgtctccgtggcactcaaaaaagtcagtaaacaggtattgaatgtaatcaagcgtcgtcggccggtcgggaaggcgtgcgatctgcactctgtcccacggtttcaggtttttataaatctcatcctggagcttgctgagccggtcttcaagccttgcgatttcagcgcttaaatccatctccgaatcctgggtgaattttttcagttcggcgattttcgtctggagttcaattaccggtttttcaaattctaatcttgcagccactcatgctcacctcctgtttggtgcatgtccagcagaaatgcgagtttgtctttcatgtcgtttcggtgaatcaccgcatcaagctggccgtgctttaataaaaattctgccgtctggaaatcttccggcagtttttccccgatcgtctgttcaataatacgtcttccggcaaatccgatcaaggcgcccggttcagcgaaattataatcaccgagagacgcgaaactcgccgatacgccgcctgtcgtcgggtgggtcatgaccgaaataatcaggccctgctcctcactgaacagtttcagcgcagagcttgtctttgccatctgcataaggcttaagaccccttcctgcatacgtgcgccgccggaagcggtaaagatgatgaatgggactttttcctcttttgctttttcaattgccagcgtgattttttcgccgacaaccgatcccatgctgcccatacggaatgtcgaatccatgatcgcgatcacggcagggaatccgctgatggttccttttccggtaacaaccgcttcattcagcgatgttttctcgcggtctttttcgactttttctaaatatcccgggaaaccgagcgggttttcagatatcattccctggttgaattcttcgaatgaatcttcatccaggaggctttcaatgcgctgctttgcattcatcgggaaatggtgcccgcagttcatgcagacgcgcaggtttttatctaactcttttgtgagcatgatttttttacatttcgggcactttgtcataatgccttccggaacatcatgttttgcctgctcagacggcacggaagcatattttttcttttttgtgaatatatcctttaacaaatgattacctcccttttgtgaagggttctcttcactgcatgtcttccgattagatagacttaataataactttaccgaaactattgtactttttttgtcaaacggtgtcatcctccattcgacattttttgctgtaaaacagacggaaacaggaggattccggaccgcaaaaagcgttgctcagccttatctgtcagcgttttcaaaagaaataaggattctgctgaattttttttaagacctgcccttaaaaaaatgccagcagtccgtatattgaacagcagcgcgttgtttttcccaacgcgctgccatttcatttttgtgttattattcgccgatgaccgtcagctgtcttgttttttcagccacttcctcagggtcgaccgtaattctggcgacacccgtttccatcgctgctttcgcaacagctttcgcaacggcaggagccacgcgtttgtcaaatggagccgggatgacataatccgcgcttaattcatcctctgaaacgagggaagcgatcgcttcaaccgcagcaattttcatttcttcgttgatgtgagtcgcgcgaacgtcaagcgctccgcggaaaatgcctgggaatgccagtacattgtttacctggttcgggaaatcagaacggcctgttccgattacgcttgcgccggctgcgcgcgcgtcttcaggcatgatttccggattcgggttggccattgcgaaaataatcggatctttcgccatgctttccaccatttctttcgttagagcgccttcgactgaaacgccgataaagacgtctgcatcttggatgacatccttcagcgaaccgtctttgcggtcttggtttgtaaacttcgccacttcgtttttcaccgcgttcatgccggccggacgcccttcgtaaatggctcctttagagtcgcacattacgatatcgcgtacgccgaaatggtaaagaagcttgatgatcgcgatgcctgccgctcccgctccgtttgcaacgactttaatggatgacatggattttcctgataatttcagcgcgtttacaagtccggcaacggttacgatggctgtgccgtgctgatcatcgtggaacacaggaatgttagtttcttttttcaggcgttcttcaatgataaagcagttcggcgccgcaatatcctcaaggttgacaccgccgaatgtcggttcaagcagcttcaccgtgtcaatgattttgtccacatcgtttgtgtcaagcgcgatcgggaatgcatccacacccgcgaagcttttgaaaagcaccgctttcccttccataacaggaagagatgcttcaggtccgatatttccgagaccgagaacggctgatccgtctgttacgactgctaccatgttccccttcattgtataatcatatactttatttttatcgttataaatttctttacaaggctcagctacccccggagagtaggcaaggcttaaatcgtctgcatttctgacttctacctttgcttttgattcgagttttccttggtttactttgtgtaaatgtaatgcttcttctcttaatgacattctaaacactccttttaagtactttgttacatattctgccgcatagactggtacaatctctggaggtgaaaaatttcagaatctttaaataagatagcacaattgtttcaattgtataacaaaactattgttgttaccactattttaacacgacgttttcgcggcccagcagctcttttaaacggtataacgcctgatggtcggcctgaatatgaaaagtatcgggcagcctgatggtctgcttgtccttttcgtaataaagataaacgccggtttcccctttatgctccagtaaaatacgcttcatcttttccagaaactcctgattgtgccggctgccttcgattttgatgtaaacagacggcgctctgtctgcctccgtctgctcaaggagagaggcggatgacataataaattgtatcttctcctgccgctcttccatttttccggacgcgaataaaagcgcgccttcttttaacagcggagacagccttctatattggtcaggaaacacgacggcttccatttctcccgtttcgtcgcttaatgtgagaaacgccatatgctgacctgtctttgtccgaatcgttttgatgcctgcgagcaaagcgccgattgacagctgtcctttcggcatctgcagcgctgttgcgatcgcttgcgccccccgttttttcaagagattcctgaaagctgacaaaggatggcttgagaaataaacaccgagagcttctttttcaaaccgaagcttgtccacgagcggaaattcctctgcctctacatattttggcttaatggagaacgattcttccaaaaacaatcccatttggtcatcgtctgcacgaaaaagctcagcgtgctctaaagccacatcaacggaggccagcaaggcggcgcgattttgattgaattcgtccatggcgccagaaaatataagggcttcgattgttttccgattaacgcttttggcaggaacgcgaaagcagaaatcgaaaagatcctcgaacggtttatgtgttcttgctttataaatatctttcactgccgagacgcctacgttttttatggcccgcaaactgtatctgacggcgccgttttcaggtgcaaacggaaaaccgctcttattgacagacggcggaaggacttggagcccgctcccctttgcttcgtgcagatattgcgatattttgtcctcattgccgatgacgctcgtcaaaagcccgcacataaaatataaaggatagtgagcttttaaataggcgagctgatagccgatcatgctgtatgcgacagcatggcttctgttgaatccgtagttagcgaatttgacaatcagatcgtagacctcgtttgcagtgactacagaatactccttttttaagcacccttcaacaaaatggcttcgctctctgtccaaaatgtccttttgctttttgctgacagcccgtctgagcagatccgcttcacctaatgaaaaacctgccatgcgcgaggcgatcatcataatctgctcttgatagacgatgacgccgtacgtgtcactgagaatatttcttacatcctcgtgcgggacttccacacgcgcccgcccgtgcttccggtcgataaatagcggaatattttccatcggccccggcctgtaaagcgcgtttaccgcgacaatgtcttcaagccttgacggcttcagacgcttcagcacattcctcattcctgatgattccagctgaaaaatccccgtcgtatcgccatttgataatagcgagaacgttttttcatcctgataagaaatctcggaaaaatcaattttcgtatttgtctctttttcaatcatcgtcttaatggattcgataagcgtcaggttgcgcaaacctaaaaagtccattttcaaaaggccgagatcttccaagtgatccatcgcatactgcgttaaatacacgccgtcatgcccttcctgcagagggacaacttcagaaagcggctctttgctgagaacaacgccggccgcgtgtgtagacgtatgcctcggaagaccttcgattttccttgcgatctgaaacactttatgaagaacggcggattcagacagccgcctgttcagctgagcggactgccgtctcgcctcctcaagcgtcattcccggcttagacggaatcaggcgggcaagctggtcggcttctttcgggctgattccgaacactctgccggtatcccttaacgccgcctttgcggccaatgttccgaaggtgataatctgggcgacgtgcatgctcccatacttattttgcacatactgaatgacctcatcccttctcgtatcagggaaatcgatatcaatatcgggcatgctgatccgctcgggattaagaaacctctcgaataacaaagaatgtttaagcgggtccacgtctgtaatgaaaagggagtaagcgacaagcgagcctgccgcagacccccttcccggacctgtcacaatgcccttttcatgcgcgtacttcataaagtcccatacgatgagaaagtaatcactgaatttcatgcgcctgatgacatccagctcatattcaagacggcggacagcacgctcatcaggagtgccgaaacggagacgaagcccctcatgacagacttccgccaaatagtcatcagctgatttgccgtccggcgccgggaaagacggaagctgtgtctgtccgaggctgacatcgacttggcattgctgagcgacacgtgcggctgctttgaccgcttccggattcttcatataaatattttccatttcttcaggcggcctcaagtataagtccggcaggtccccgctctgatcctcccatttctccccggctttaatggcgcacagacagcggtacgcatcttgatcttctttcttgatataacggacatcccccgccgcgcagacagcgatttccgtctcggctgacaggcggagaatttcttctgataatgtctcatgtcctttaaacggctggtaccctaaataaaaacggccttctccgaacaattcccggaatccttcggcaacccgaaccgcttcttcaaactctcctgcttgaagcaggctttcaatgtacccgttttcaccgggcgtaatggcgatcagcccttcatgatagctcttcatccattttcgcttcatgccgccctttgctatggattgcagcgcacttgagattttcagcaggttctgatatccggtgtttgtctccgccaaaagaacaagcgggcgtgcttcaagctcagtttcgtccgtgtatattgaagccgtcagaccgataatcggctttattccgtgtgacttgcatgctttataaaactcaatggcgccgtacatcacattttcgtccgtgagcgccaatgaagaatatccgagctccttcgcttgtgtaacaatctcttttacagaagcggcgctgtttaacaggctgtagccgctacgtacttgaaggtgaacaaaagacaatgccgccactcctttcccgtatacgttcaatttgcctttctacattataagacgggttttcttaagaaacaaatgttcttttttgactcatcatcatacttgtccgtttcgctcaatatgatagaaaagtgaggtggtgtatatatggatcaggaagccggctttatggcgaattttatcagcagttattttatcgccctcggtgttttgctcggcggagcgctcatcggcggcgtcggagcttatttatcaggcgagcctccgcttacagcgattacaaaattggcgaacaggctgaagatctgggcgcttgtcgcggccatcggaggaacgtttgacgcggtatacagttttgagcgggggctgcttgaaggcaacacacgcgacattttcaaacagcttcttttaattatttcagcaatgggcggcgcacagaccgggtggctgattgtttcatggctggcacaggagaatatttcctcatgagaattcccgagtattataaaaaaccgggatggcagcgtttttttgcgggaatgatgtgcggagccatcgtcagctggctgttctttctgtttacatacggaacgtttcaggaagaacaggtgacgttaattcaaaaacagcgggagcacgcacgggatttgaaaaaccagatctccatctatcagaaggatcttcataaattaaatgaggataataagcaaagactgcttatccaaagcgtcgatgtgaagctgatcaatggagaaaaatacagaatcgcccagcccgataagatgaaatttgaagaacaggtgaaagataatatttcggaagtcatcacaaaggatattgaaagtgtgtataaaacaaaggaacttttaaaacggacgattgaaaacaaggtgtacaccataaatgagaaggaatataaagctgaagtaaaggaactgacgatttatacgagattgtctgtcgaaattcatatttcttttgcgacgtaattatgtcatttttaaaaattttccatagatctgtcgcttttttctccgcttttttataaactgtaaatgagacattttcaatgattctgaagggaggaagggaaaatggaggtttttagtgaacgccgcttggcaaaagatcatgcagaccgaatcagaaaaggctattccgcatatgcagaaacagacacactcgcttccctcataaaaaaagaactccaaatctgtaatctccgcgtctacgaagacctgactgaattcggctgctggttcatccccgtgacagatgaacactaagaaagagggtctcccctctacttgtgttcgttacatacctcttcaagatcagcaagaatcggaccggtttcatcccagctgtagatggatgcgccggccgccagcggatgtccgccgccattgtatttccgggcaattccattgatgaccggaccttttgaacggaaccggactctgatttgatcgtcttcttctatgaagaatacccaagcgcgaatacccgaaatatttccgagtgttccgacaagctgcgatgcttctgaagcggtggttccgtatgtctccaaaatgtcttttttaatgaaaacggaagcgacgccgttgtcagacaatgacacattttgataaataaagccattcagcttcaccacatttaattttgtttcatacaattgattgaaaagctctgacggtgaaaaagggaactcaatgagctctcccgcgtatttgaatgtcttttttgtggtgttcgggaataaaaagcgtcccgtatcactgacgatacccgcgtagatcagcttagccgctttcgtattcagcttccagccgtgctcttttccttccaggtacagctcatagatcatttcgcttacggagcttgcattcgtatcgacccataacagatcgccatatggatcttcatttggatggtggtctattttcatgagctttgcgccggaatgatagcgctgatcgtcgatccgttcttggtttgcggtatcgcacacgatgacaagagcatctttataggtttcgtcatccacctcatcgagggaatataagaaagacaaggacggctcaggctgtccgacggcaaaaatatttttttcgggatacgtttcccgcaggatttccgtaaggccgcactgtgatccgtaagcgtctgggtcaggcctcacatgtctatgtaagataatggtgtcatataatgatatggttctgatcagttcggatttcatcgttttctcctttttgtttttattcatttaatcatactctttatccgcggaaaaggaaaatctttcaggaacggtataaacagttttgcaaactcatataatggaggatttcatttatgctggtttttgtttttctcatcgggctttctgcctgcttttacgtgtattacaaagtaaaaggcatccagacgaaacgggcgctggagaaggaattcttttcggctaaatcaagtatggcgttaggcgcgctggtgcttttgtacggagtaaatcaaatgattctgtttcactccgtcctcacccttgtcatcggcggcgttttcattttaatcggagcaggcagcgcatgggccgggtataaagcctataagcattatgaacccatccatgcaaaggaagcggagagggaccacgcataatgaatgtcaagggaccgagatgcgtcccttagcttctctccatcagctgcaccatcagcatcgcttttgaaacgatgccgctttggcttgacacttccacttccattttcccgaatttccggcccgcttctaaaatgcgcggtttcacttcaatgaccgattccatctgaacgggttttaagaagaaaatcgtaatgctttcaatgaccagctcgccgcgtttgcgggaacgtaaaaatcggctggcggcctgggttaaaatcgttgtaaacaccccgtaagaaatcgtcccgagctgattggtcatctgcggcgtgacttcatattgataaacggccggcgttttatcatcttcctcttctttaaatccccttgaaacgatatcatcaagcttctccccgacctgaggctgcttttgaaccatttgaagcgcttttaagacatcctggcggctgatcatcccgatcagtctgtggtgcccgtctgtcaccggaagcacttcgattccttcccaaaccatcatttgagccgctgaggcgacagacgttttcccgatcaccgtgacagggtttttggtcattactttttcaatcggaactgatcggtcatgcccggcgatatctttcgatgtgaggattccgtggattttcatctgctgatcgatgaccggaaagcgtccgtgtccggtttcatagtttttttcgtaccatttctccagcttatccttaggagacagcgtcactgtccgatctgcgggcgtcaaaatgtcctccacgagcacaatttctttttttatgagctgatcataaatcgcccggttgatcattgcggctaccgtgaaggtatcatagctcgtggagagaatcggaagctcaagcatatcggccagctcgataatgctgtcatcggtattaaaccctccggttaccaaaacagccgcacccgcttcaagcgcctggcggtgagcgttgattctgttcccgacgattaacaggttccccgccgctgtataacgcatcatcgcgtcaagctccatcgcgccgatcacaaacttgttcaacgttttatgcagaccggcttttccgccgagcacctggccgtctatcacattgacgacttcggcgtatgtcagcttttcaatattttcttttttcttctgctcaattcggatcgttcccacacgttcaatagtggaaacaaaccctttattttcggcttccttaatggctctgtaagccgttccttcactgactttcatttctttcgcaattcgtctgaccgaaattttttcaccgacaggaagcgaatctatgtatgataggatttgttcatgctttgttgccaagcgtttcacctctaaggacagtcttctgcttttattataagggcacgggggattcattcgcaatgagacgcccgaaaaaagacggcaccgcaaaaagaccttctgaatgcgtgattcagaaggtctttgacattatgtcaggcaagctcaatggtctcgccgaccgccatgactttgccgacgccaccgggcagactttcggcgaaagcgtcagggtcctgttcaatgacagggaatgtattgtaatgaacgggaacgacttgtttcgccctcagccattcagccgcgagtttcgcatcttcagggcccatggtgaagttatcaccgatcggcagaaacgccaggtcaatgtgattcagttccccgatcagtttcatatctgagaacagcgccgtgtccccggcgtggaaaatcgttttgccgtcaatcgtcaataaaatccctgccggcatccctgtgtatgtgatggttttgttttcttcatcagtgactgccgatccgtggaatgcctgtgtcagtttcactttgccgaaatcaaattggcgcgccccgccgatatgcatcgggtggacgtttaaacctttaaagccgagataaacggccagctcattcggcgcaataacgagcgcatcgttttgtttggcgatctgctctgtatctccgacatggtcattgtgtccgtgagtaagcaggatgacatccgctttcacttcttccggcttcagatttgtcaggctgtttccggtaataaacggatcgaaaataatgttatgggttttcgtttccacatgaatgacagaatgtccgtgataagtcactttcatcgttttcacctcataaaaagttaatatttatcaagttcccttttcgacaaacgaaaaaacttacagggattgatgcctgttaatcacattcagcccgcctgttgcttctatgaccgttccggttacaagatcggaatcttcttcacataaaaaggcgatgattctcgcaatgtcctctccggttccggacctgccgatcggcgtgttttctttgccgatcttccgtcttgcttcttctatagacgcttctttcatatctcctacaatatcacccgggcagaccatgttggccgtaatgcctgattcggcttcttcaatcgcaatggttttggttagcgaagccaatccgactttagccgctccgaaagcggaacggtgcagccagcccggagcatggtcagctccttgaaagccgtatgtaataatccggccgaaccgctgctgtctcattaccgggataaccgctttaaacagatgaaaaacggcgcttaaattcccttcaagcatgtcataccattcgtgatcggaataatcggcaagctttttgcgctcaaatatgtacggcccggcattgttaatcagtatgtcaatccttccaaaccgctgaagggctgcatcggcgatccgcatgagatcttcttttcgggttacatcgcccttaacgaattgcaatctgtcatggcaccggggataatcggccttcagacaagcgaccgcttcttcgtcctgtctgtaattcactgtgaccgaaaagcctttttccagcagcatttcagtcacttttcggcccaatcccttcgtaccggcagtgattagagcatgtcgcacattgaataccctccccaggcaacgttgccgcttcaatagaataaagtcgtttctccctctactttactataaacaagcggcaatatcacttttttgcacttcaatcgcacgaaaaaaagccgtctttacagacagcttaattttctgaaggggctgaggcttcctccaggccgacataaccgctttgatatgcctctgagatgagccgggccgtttcttcactttctttttcatcataaatgtaacggtcttgttctttgcgcattccttctacctcccatcattatagatgtagggtgtctgatatgacgggaaaatatgaaggtaattttagcaaattaaacgccggcgcaggcttttgcttttacaagtgcctgttttacctgctgaaaacccgttccgccggcgctcattcttttttcaaccgcgtgatgcggatcgagcacggtatagatatcttcttcaaagagactgctggcttgaaggaattctgcaaacgccatatcacttaaataaattcctttttcaatgcagctgtacacaagcttgccgaccacttcatgcgcttctctgaacggcatgccttttttggctaaataatcggcaagttcggtggcgtttgaaaaatcttgttttgtcgcctgtttcatgatgtctttgtttacggtcattgtttcaatcatgcccgtgaaaatctgaaggcttccttcaacggtcttcaccgtgtcaaacatgccttctttatcttcctgcaggtctttgttgtaagcgagcgggagccctttcataatcgtgaaaagacccatcatatcgccgtatacgcgaccggttttcccgcggatcagctccgccatgtctggatttttcttttgcggcatcatgctgcttcccgtcgcgtacgtatcatccagttcaatgaatctgaattcctgcgagcaccaaaggatgatttcttctgagaaacgtgaaaggtgcatcatgagcatgctgctgctgcttaaaaactcgagaataaaatctctgtcgctgactccgtcaagactgttctcataaatggaatcaaagccgagcagctccgccgaataattacggtctatcggaaacgtagttccggcaagcgccccgcatccgagcggcgatatatttatccgcttcatggcgtcacggaaacgctctttatcccgttcaagcatccaaaaataggcgagcagatggtgggcgaaagaaatcggctgggcccgctgcaaatgggtgtaccccggcagaattgtctcgacattggcctccgctttttcgatcagcgctttttgaaactgttcaatcagcacgatgatatgcgagacatggtctttcaaatataaatgcatgtcggtcgccacctgatcattccggcttctcccggtatggagcttgccgccgagcggtccgatttcttcgatcagcattttttcaatattcaaatggatatcttcataatcaacagagaattcaagcgttccttcctctgctttttgcaggagggtctgcaggccctgacggatggcgctttcttcttcttccgtcagaatgccgcattttttcagcattgctgcatgagcgagagaccctgtaatatcctctttgactaagttttggtcgaatgtgatggatgcgccgaactcatcgacccacttttccggtgttttttgaaaacggcctccccaaagctttttcatgcttcaatctgctccttctttttcacaatgctgtttacttttgtcggcagcccccagagctcgataaagccgattgccgcgtgatggtcaaaagcatcgtcttttgtatatgtggcaagtttttcatcatagagagaatattccgacttacgtccttctacaatggcatggcctttaaacagcttgacgcgcacaacgccggtgacgtgtttttgggtttctttcaggaatgcaagcagtgcgtcttttaacggtgagaaccataaaccgttataaatgatttcagacagtttttgttcaattgccggtttgaaatgagccacttctttcaccaacgtcagatcctcaagctctttgtgagccgtaatcaaagtcattgcgcccgggcactcatagacttcccgggacttaatgccgaccaggcggttttcgacatggtcaatccggccgattccgtgctttcctgcagtctcgttcagcttgagaattaaatcagcaagcgggtaggatacgccgtcgattgaaaccggaacaccggcttcaaatgcgatttcgatgatttcaggaacgtccggcgtgttttcaagagatgctgtcaggtcatatgccccttcaggaggcgccgcccacgggtcttctaatataccgcattcattggcgcggccccacagattctggtcgatggaatatgggctgtcaaggttgatcggaatcgggatgcctcggcttgcggcatattcgatttcttcttcacgtgaccactgccactcacggaccggagcgatgacctccagatcagggtttaatgatttgatggatacttcgaaacgaacctggtcgttgccttttcccgtgcagccgtgcgctacggccaccgcgttttctttttccgccacttcgacgagttttttcgcgattaatggacgggataatgcagatacgagcggatacttgccttcatacattgtatgagcctgcatagaaatgagcgcgtactcccgggcgaattcttctttcgcatcaatcacataggagttcacggcgcctacttccagcgctttttgctgaacgaatgccaaatcctttccttcacctacgtctaagcagcaggcaacaacatcgtacccctgctcttgcagccattttatcgctacagaagtatcaagtcctcctgagtatgccaatacaacctttttttgttctgccatgttaaaagctccctttgtataaaaattagttttaattaataaaaatgcattttgtatgtatacactgtaacaagtaacttttgttttttcaagccttttataaaaaaaactccacccaattttttgagcggagcagagcctttttatacgtttataaatcttttcggatttcccggagcacatgaggcagttcaggaataatcagtttactcattgcaagcctgacggcgcctgaggagcccggtgtgcagaagaccgcggtattttggattacacccgccgcggctctggacaaaatggcggcggaaccgatgtcctctgtatagctcagcatgcggaacagctcgccgaatcccgggagctcttttgaaaacagcggcgtgaccgcttcaatcgtgacatccctttcggcaatgcccgtccctccgtttaacagcaccgcatctgtatattcatccatacagccggataaaacggctttctgcaattcatctttttcatctttcacaatgtcataagcgaccgtttcaaatccagcttccctgatgaaatccatcatgacgcgtccgcttttatcggtttctttcgttctcgtgtcgctgaccgtgatcaccttgcagcgaaccgctgacggggcttcttgtttatgttcatgcacactcattgtttcacctcatcatttatgtaataaacatatcgtaacgtttgattgtgcggcattcaataaaaaagcacaccccttgggatgtgctttctttcgattattactgtgcaaggcggacaacgtcgcgtgcgatcatgacctcttcatcagtcggaatgatgatgactttgacaggagagtgaggatagctgataaacgcttcctcgccgcgcacgttgttcagcgcaggatcccaataaacacccatgaattctaagccgcgaagtacgcgttctctgacttcaacgctgttttcaccgataccggccgtgaaaataatggcgtcaacgccgctcattctcgccgcgtaagaaccaatgtatttatggattctgcttgcgaacacttcaagagccgtttccgctctttcgttgccttcttttgtagcttctacaatatcgcgaaggtcgcttgagaagccggatatgccaagcagtccgctcttcttatttaatgtatttaatacttcatccgccgtctgatctgttttttccataatatacggaatcaaggcagggtcgatgtttcctgaacgtgttcccatcgccacacccgcaagcggggtgaagcccattgacgtatcaatggattttccgccttcaacggctgcgatacttgctccgttacccaagtggcaggaaatcaggcgcaaatcttcaagcggacggccgagaagctcagctgcgcgctctgtcacgtatttatgagacgtgccgtggaaaccgtatttgcgaatgccgtatttctcgtagtattcatacggaaggctgtacagataagattgctcaggcatcgtttggtggaacgccgtatcaaacactgcaaccgcaggcacattcggaagcacttctttaaaggctttaatgccgacgatgtttgccgggttgtgaagcggcgcaagttctgaaatctcttcaatctcactgattgtttcatctgtaagcaaaacagaatcgctgaatttttctccgccgtgcacaacacggtggccgattccgtcaatttcatttaaatcctttataataccgaattcagtcagcttgtgaagcagcatcttcaccgcaaccgcgtgatccggaatatctgtgacttctgtatttttttcgccgttaacagagatagtgaaaacgctgtcggcgataccgatccgttctactaaaccttttgttagcaccttttctgaaggcatttcgaataactgaaattttaaagatgagcttcctgcgttaattgcaataattttagacataaatgacgctcctatcaaaattcttcttcgtttgtttcgttcttttttcccagaccgtaactgcagtccaaaaaatatctgacttttccatttaaacattgtcaactcagcatttcaagtcaacatccatattggtaccgcttacaatatgaagtcgttattttctgataaattcttcttgtgccaaatggacggcacggacttacggaattttattttctttccttaatttgtgttatttccctgatttccattcattttaaacagcaaaaaggcagcgcggattctgggtcacgcgctgcctgttcggccattatttttctttttgaatccattgatccaattttgccatcatctcccgcatcgcctgctggttcgcgaaggaaggaagattcgccaaaagcgtttgtttcggcgggtttgcgtctccgccttttttctgcaaaattaaaatgctctttgcctgcgcttcgtctttaaacagagtagccggcagctgaagaagagcgttaatatacactttttccgccaaaaactgcttcagtttatcgctttgggcgctgtcaaacaaatgattcgggatcataaaaaataagtatccgcccggttttgtatgcttgacgctctgctcaataaataagtggtgggcaaatgagtggccttcatctgctttcagctcaaacgcttcagcgccttcgtcattcggatagtagccgaccggcagatcgcagatgaccgcatcagcctgttcgataaataacggctgaagactgtcctggcagaacagctccatttctttttcctgcagattcgcttgggcataagcaatcttcagaaggacatcatcaatatcaatgccgaagctttttgccgctttgtcagaaagctggtttgccgcggtcagcagaagatttccggtgccgcaggcggggtccagcaatgtcaggcctttttggctgcccgtaaatttattcacgaggtaactgatgaaaaggccgatcgtatcaggcgtcatctgtctgttcggatgggatttatctttcagcccttttaaaatggcgagctggaacgccttgcggatccattcatgctcccattttttgaagtctgctttcgcaagcaggcttttaagctcgccggtttgcttttcctgaagcggcagctgttcggccgtttcgagaaaatacatctctcccgcttccgcaagcccctcaatataggacagctgaaggccttctgctatcactttggcggcttcatctaaaagttcataaatctgaccgacatggtcgtgttgcatactgtttcctccttgccatgaaaagagctccgcggcagcacccggagctctttctcaatctttacttgattaacgcttttgcagcttcgataggcttttcataattcgggtggtttgtcgcttcacttacatattcagcgtaaacgacttttccgtcttggtcgagaacgaaaacggaacgtgccaaaagacgaagttctttgatgtaaacaccgaatgcttcaccaaatgacatctctttatgatccgataatgtttcaactttatcaattccgttcgctccgcaccagcgcgcttgtgcaaacgggaggtcggcactgattgtataaacgttcacatcaccgagttttgctgcttcttcgttgaagcggcgcgtctgtgcatcacatacgcctgtgtcaatggaaggaataacagatatgatcgttacttttcctttcatatctgctaatgtcttctcttctaatccgtttgtcaaaaccgtaaagtcaggagcttggtcacccggtttcacttcttgtccgatcagcgtcacggctccgcctttaaatgtaatttcagccattctgattcctcccttatctatgtatagctctatcatagtcgagtttcaggcaaactgcaaaggttatgccgcatcgtaaaaaaagctaactgcgggcggcagttaacttttctcttataaatcgatatccgttcttttttggttccggcctttttcattctttttaaacatatgctggatgcgttcaatcgtttgaggcgcggagtctaacaatttatcaatcagatgggtgttttcgtctaaatgaagcatacgcacgccgtttgttccgacaatcagaaacgcaatcggcgtaatggatactccgccgccgcttccgccgccgaacgggagcttctgctcttttctttcatcgtcctcggttcttttttcagccggctttcctccaaactcgcttccgcccgccgcaaatccgaagccgacttttgataccgttaagattacgctgccgtcaggcgtttcaaccggatcgccgatgattgtatttacgtcaatcatttcttttaaattttccatagcggttttcattaaaccttgaatgggatggtctgccatatgcgctcctccttaaactgatgaatcattctttgaagcaaccggaaccggctgtttctttcgtatgatagaaagtccgttccgcccgtatttgagcaatttgaaagctgcacctataagatgtccaaaacgaaaaaagaatatacactgcaaatgcgtcttggaagcaggcacttgaaaagacggaatgacttcgcacaccggtttatgtataaaacgcagatggtcgtacagcatcgccgtaaggcccccctttacggcccacacgcctccggcggcgattcccgtaacggcagcgtcctttattccgataaccgtcacccattcgaacttcgtcacacggactcccgcaagaaacgaagcaccgatttggcgcatcctgacgacctgttgcagaatcatttctattctgtcaatggtctgtttgacatcttcaaatgtgatttttttcttctttttctgctggcctttcatttcggatttcgtgtcctgtttaacatcaattgacgcatcttcgctgtttattttaatgacgggccacgttttttttatacggatcagcccgtataaggccgagagtttaaacgtcattttgtcgttatctttatcatgcagatattcgaaagtcagatggattttcatcctcatgagcagccaggccaaaatgagaatgagaataacagctgctgcggcatatcccataagcttcacttccttagctgcattatcgccaaatccaaaaaaaataaacccggacgtttctccgggtttactgctttttatttacggtacagcgcttcgtgaatcaccgtggtgtcagcaatcagatcgtgaattccctgctttttgggcgtaaacgcaatgacgatgtaaagaatccagattttatcgatataacgccccaccgcttctctgaaaatgacggtgccccatgtcagcggctttccgggcgccaaaggagtgacctttaacccgaaaaccattttgccgagtgtctgatgaaaccattttgtcatgaacacaaaataggcgaggtagacgatcagggttgtgacggaatagactgagattgtaaacattccgcttgttttcgggagattcatcagcgtgaaaaccggtgaaacgatgagatggttaagtccccagatcaccagccaatcgagaagaaacgcccaaaatctgatccaaaagcccgcgtatgccggctcgagcgcctcctgttgtgcggcttcctcttctttgccttgaaagccttcgtaaatcgcgtccattctttcttcccccctactttgcatagagatacatcatccgcggcgaaccggattgcgaaataagctctttcatattcagaaaatcaatttcgcttttaaacattttcgctgcgctcatcgaaaagagcgagcctaatccgaatccttcttcgtatgtgatgactgaagcgtttttcatatttttatgatcctttttcatcgcgctgatcgtatcatcgtaaaaaccgagttcatcaacaaggccgatttttttagcctgtctgccgtcatagacacggccgtcggcaatttttttcacatcagcttttgacatgtgccgcccttttgaaatgacattgacaaatccttcataagaatcgttgaccatcgtctgcatgatctttctttcttccttcgtcatgtcgcgggtcggagacatgatgtctttatgcgcgccgcttttaatcgtttcaaatttgatgccgagttcatcggcaagcttagagtaattgacgctttccataatgacgccgagtgagcctgtgagcgtttccggtgaagcatagatcttatcggcggcggttgagatatagtagcctcccgatgccgccatggagcccatggatacgtatatcggtttcttcgtttctttctttagttcttccagttttttatgtatttccgcgctttcgtatacgcctccgccaggggaattgattttcaggacaattcctttgacgtttttatcttctttcgcacgctcaatatgttttaagaacgatctgtgatcatacccgcctgagctgagcaggcctgcggactcgccgctgtcctcgatcgtgccgtccacttcaagcacggcgattttactgccggggctgccctcatcaagcgtcacttcctctgagtcatctgtcagcgaggcaaagccaccccctgtatctccgacatttttcagcaccccgacggtcacacttgcgattactgatacgccgaaaatgccgatggcgatgacgagcgcaatccatctttttgcattcattctgttctgcctccttttctgtcaatattcgtacgttcccccgtaaaaaaagattcatttttttcatgaagcgctttcacttaacggataaacaggaaacatgttacactattgccacaggtattttaacacaatacctgatgggagaaaaacgtaaatatgacagcaaaggggaatggagatatgaccgatcttcgccgcaatgtttatttttttcacaaacaagacaacgaaacaaaagaacaagtcagctctcttatgcaattggctgaatcgcacggttttacagttgcggctcacccggaggatgcggggattatcgccagcatcggcagcgacggctcatttctgcaggccgtcagaaaaaccggattccgtgacgactgcctgtatgtcggcatcgctaaaaaaggaaaagcccatttgtactgtgattttcacagcgatgagcctgaaaaaatggcggacagcatgaccgcggaacagcttgaggtcagaaaataccctcttattcacgtaacggtggacggcagcaatcattttcactgtttaaacgaggtttccatccgttcaagcattattaaaacgtttgtgatggatgtgttaattgatgatcttcactttgaaacattcaggggagacggcatgatcatttccaccccgacaggcagcacagcctacaataaatccgtatcaggcgcggttgtcgatcctttgatttcctgcatgcaggtatccgaactggcctctttgaacaacaacacatatcgaacactcggatctccgtttattttaagctcggacaggaagctgacactgcaagtggtgcaggacggcaatgagcatccgattatcggacttgataatgaagcgctcagcacgcggaatgtcaaaaaagttgagattacactttccgataaaaagatcaagacggtgaaactgaaagacaactctttctgggaaaaagtaaagcgctcatttttatcataaaaaaagaggacgggcattaacgcctgtcctctttttcatatacaatacggccgccgacgacggttttgacagcttccagtttatgaagacttttcgggtccattttaaacggatcaccactgagaatggtaaagtcggcatcatagccgggggctatccgtccgcggctatgttctttatggatgattgccgcgcttccctccgtgtaaagctgaatggcttcgtacacggtcagacactctttttcataataggccggaccttcagggtgctgcttgctagtacggagcacagccgattgaatgcccagaagcggatcggccggttctatcggggcatctgaacctccggcgcacagcagcccttttgacagcagtgttttccaggcaaaagccgttttcatccgctcttcgccgagccggtcaatcacccacggaaaatcactggcgacaaaatgcggctgaagatcaaggccgatcggaagccgggcggctctttcaatcagaccgtcatctaaaacctgcgcatgaatgagcctgtcaagctgtccgggctttgccggatatctttcgataacatccagcaccttttcaaatgcgaggtcgccaatcgcgtgcacggcgatttccatccctttctctctcgctttagaaacaagagaggcaagtgttttgtcatcatgcacctgaacgccggaaacagacggatcatcatgataaggctgtttcaatagggctgttctgccgccgagcgcgccgtctgcaaagattttcatcgctccgtattccagatacgggccggtcgacttgtccagagtgctccacctgtcgacggcttcgtgatgaacgagcagatgggcgcgaaaaggaaaaaggccgctgccggttattgactcgtacgcggcaacgggaacggacgcgtctccgtagtatgccagatcctctgaatgcccgccggtcaggccttttgaccagcagtccgtgaccgccgtttgaagagcgcgtttgacatagtgaagtgagacgggcggaagagcctgtgtcacaagctcttgggctttatccagcagaaggcctgtcggaccggcgctgtcccgggcgataatcccgccgtttggatcaggtgtttcgtttgtaatcccagcagctcgcaatgcggccgaattgaccgcaacggcgtgcctgcatacccgcttcagcaggacgggacggtcgggaaagagcgggtcaaggtcatgcttcgttacgtaaaccggccgctcaaacagattttcatcccagccttcgccgatcagccattcaccatcttccaattcacgctctgcttctttaacggcttgcagtattgcttcttttgatgtcagctgcgacaaatcaaggcgaagctgtttttcaccgtgtccgattaaatgcatatgactgtccgtaaacccgggaaacatgactgctccatgtaaatcgatttcctccgtatcaggcgaaccgtatgtttcacggagctcctgaaagctgcccgtctgtctgatgacgccgccttcagtataaacggcttcagtgacatggttctcctcaagcattgtataaatggtgccgccgtgccaaatcgctttcatccccgctcaccctttttttatattatgcttttttatccgccttcagccgttcttcgcgctgtctcagctccacccgtctgatttttgcagacgccgttttcggcagactttcgacaaattcaatttctctcggatatttgtaaggcgccgtaatcgtttttacgtggttttgcagttctttgacaagtccgtcactgcgcttttcatcgttttgcaaaacgacataggcttttacgattgaacctctgatttcgtccggactcgccacgacggcgcattctttcacttccggatgcttcacgagcgcgtcttctacttcaaaaggcccgattgtatatccggagctgacgataatgtcatcattgcggctttcaaaccaaaaatagccgtcctcatcctttttcgcgcgatcgccggtaagaaagtaatctccgcgaatctgctttttcgttctttcagggtctttataatattccttgaataaggccggtgtgctcaagtgcacggcgatatcacccgtttcgcctgtttcgcatacttcgccttcatcgtttataatttcaacttgatttcccggtgtcggtttccccatgctgcccggcttaatatccatattcttcaggacgccgactaacagggtgctctccgtttggccgtagccgtctctcactttaatgccgaaatgtttctggaatacgtcaatgacttcccggtttaacggctcacccgcagaaactgcgctgtgcagagcagaaagatcatatttgtccaattcctccacctttgccatcaggcggtattcagtcggcgtacagcagaagacattaatctgatggcgctcaagcagttctaaatacgttttggcgtcgaacctgccgtgataaatgaagcctgttgcgccgcttcccagaacggcaagcagcgggctccacacccatttctgccagccgggcgccgcggtggcccagaccgtatcgtcttcagaaatatccagccatgcgccggcggatgtttttaaatgggcaaaggcccatccgtgtgtatgtacaacgcctttaggctggccggtcgtgcctgaagtataggataaaaatgccatatcctctcttgttgtatctgctgtttgaaaactgtctccgtccgcttcaatggttaagaggtttttccagccggcatcattttcaccaatagacaatgtcacgagctgatcggtgttcacctcgtcaaacgcgtttataaatgaaggataaacgataacgcccttaacatcggcgtgtttgatccggtattcaagatctttagcacgaagcatctccgagcaaggaatgacgaccatccccgcttttaagatcgctaaataaacggcatacgcttcaagcactctaggaaccatgacaatcagcttatcgcctttttcaaacccgaaacctttcaggcgggctccgattttattcgtttcttccatcagtttttcatacgtccagactttcttgctgcctgtttgatcctcccaaataagcgcgttcttctctttggaacggctgaacttttcgatttcattcacaaggttatagttctttggggcgattaaatcttctcgttttaacacgaacaactcctcactttctttccccattatacataaacataggacgttacaataaagatatgcataaattgcttcccgccttctatctttattcatgaaaaaagagcggggaattccccgctctcttagccattatgtgaagttgtgattaaaactgttgctggttgcttccgcccatgctttgctgagcaaaagaaacaagacgttttgtgatttctccaccgacagaaccgttggcgcgagaagttgtttccggtccaaggtttacaccgaattcagaagcgatttcatacttcatttggtcgatagcttgagcagctcctggcactaaaagctggttgctgtttccgctgtttgattgttgtgacatgtgtatcacctccttgtgagtatagaatgtgataaaacacatgtcctcattcaaaaaaactttggtaattgtatacagttctaaaacaggtccgcgaatttatcgtgagcttcttgttctgagtaaacagttatcgtttcgatgccggcagccgcctctgcaatcagcggttcaaagtcaacaaagctttcgaagtgctcgattttttcttttttcgggcgtgttttcggacttggcggcgtaaagatggtgcagcagtcctcaaacggctgaatgcttgtttcataagtgccgatttcttttgatttctcgataatttctgttttgtccattccgattaaagggcgcaaaatcggtgttgccgtcacggcattgatcgcatacatgctttcaagcgtctggctcgccacttggccgaggctttcccccgtaatgatcgcgagcgcttttcgttcttctctgattctgtctgcgatttgcagcatgagacgccgcgtcgccgtcatcgtatagttttccggaatttgtttttggatgagttcctgcgtttttgtaaacggcacgatatgaagcgtcatactgcctccgaaccttgcaaggcatcccgcaagatctatgactttctgctttgcccgttcgctcgtatacggcggactgaagaaatgcacggcttccactgataatccccgtttcatcgcgtaaaacccggcgaccggactgtcaaaaccgccggaaagcatcagcatcgctttacccgcagaaccgacgggaagacctccggcgcctttttcatcacgaatggtcaggaatgtcgcttcctccctgatttcaatccgaagcggaatatcgggattcttcacatcgacggttaatccttccgtgtttttcaaaatgtggccgccgatctcagcgttcattgcgttcgtatctaactcaaactgcttgtaagcccgtttggtcgcgaccttaaaagtatttcccggtgtatattggccttccatcgcggctaatgccgtttttttaatgtcttccagcttactttcgcatttaattgcgagactgaagctctgaatgccgaatatattctttaataaggaacatatttcctccgggttttctccattaagagtaattgacatccggtcccggttggaaaagtattttacttttttataatcctttaataccaggcggatattctgttttaatctttctataaaactgcgtctgttttttccttttgtggatatttcaccaaaacggattaaaatatgatcgtaattcatatgctacctcatcattttttttagtttttgaacagccggcaccagcgcggccataaacggctctgtgatgtcagccgtgtggctgaagttcaggctgactcggatgctgcttgatgcaatctgttcgcctttattcatttgcaggaggacacggctcggtttgtgctctcttgctgaacatgccgcggttgtggagacgtatattcctttttcctcaagcatgtgcagcagcacttctgctttcacacccggaacggaaaaattaatgatatgcggcgcgctgttttcagcaggagtgttgatgacgaccccgtccgtcctgcaaagcctttccataagcgcattcttagcagcttccactgaagaaagccgctcgttcatgtcacgtgcggaaagattgaccgcttttgcaagggagacggcacccgctgtatgttctgttccggcacggacgcctttttgctgcgagccgcccgtaataaggggaatgagccgcgttccttttttgacgatgagcgccccggtcccttttaagccgtgaaatttatgccctgaaatggtacacagatcaatgcccgcttcttctatagacagggggactttatgaatgccctgtacatgatcaacatgaaacagaatattcccatgctgtttcaacagtccgccgatttcctttataggctgaatggagccgacttcgttattgacatgcatgacgctgacgattatcgtgtccggcctgatagccgcttttacgtcttttaaagaaacgaagccgtcttgatcgaccggaagatatgtgacttcaaagccaatcagctctgtcagctgatcaagcgtctccgtcacagaagggtgctcaatcgctgaagcaatgatatgtcttcctttattcatgttggcccaggcggctccctttaacgcagcgttgttcgcttcagtcgctcctgatgtaaatacaatatcataattttttaaacccaaggttttttttatttgctgagcggccgcttcaaggagctgctccgtctcagttcctagccggtgcagagacgaaggattgccgaaataacggctgctcgtctgtttatacacatccaaaaccttttcatacggctcggtcgttgagctgttatctaaatatatcatttttttttactccttttatgaaaacggtacatcgtatgatatttatgctaccataacaaaagtaaatataaattcgcaataaatcgagtattgacttctctggacattgcaatataataagtaatgttcgttttgttatattatctgacaattaattgacagaatatttcaacatagtatttaggaggacttttatgaaacactcactacctgtcaaagataccgtgattatcggtttcatgcttttcgcactttttttcggggcaggaaacatgatatatccgccggagctcgggcaagcggcaggacataatgtctggaaagcgatgggcggtttcttactgaccggcgtaggtctgccgctattgggtattatcgccatcgcattaacgggaaaagatgcaaaaggacttgccgataaagctcatccggtattcggcacgattttcaccgttgtgctttatttatcaatcgggccgctttttgcgattccgagaaccggaaccgtttcatatgaaatcggtgcagttccgttcttaagcggtgttccggaaagattatctttatttattttcactttaatctttttttccattacgtattatttagctcttaatccgtccaaaatcgtggacagagtcgggaagattttgactcccattaaattcggtattattttaatcattgtcattaaagccatcgccactccgatgggcgggctgggcgccgtacatcaggaatactccggaacgccggtgttcaaaggatttttggaaggctataaaacaatggatgcgctcgcttcaatcgtcttcggtgttgttgtggtcaatgctgttaagagcaggggcgtcacccagcgaaaagcgcttgcggccgcttgtattaaagcgggacttattgcagcggcaggtttgacattcatttatttatctttagcctatttgggagcgacaagcacaaacgctgtagggccgctcggcgaaggcgcaaagattttatcagcttcatccgattacctgttcggttcattaggaaacattgttctcggtgccgccatcaccgttgcgtgcttaacgacgagcatcgggcttgtcacatcttgcggcgaatatttttcaaaattgattcccgctttatcatacaaaatggtagttacgattgtcacgctgttcagcctggcgatttcaaatttcgggcttgctgagatcattgcattttcagttcctattctatcagccatttacccgctggcgattgtcattattgtcctttcctttattgataaaatctttaaggaaagacgggaagtctatatcgcctgcctgatcggaacggggctgttcagcatcttggacggcttgaaggcagccggcattccgctcggatcactagattcattcttaaacgcgaaccttccgctttacagcattggaatcggctgggtgcttccgggcattgccggagcgatcatcggctgtatcatcacgttttttaccagcccgccaatcgaattgaataaagcgaaatcgtaacattcagcgtctgcggcttgacgtatatcagccgcaggcgcttttttatattccgggagaaacaaaaaaactgcacctctgatttccatcagggtgcagtttttgcttgtacgctatgaagcagattgatcagctttaatttttttcacggcgccgggagccgctttttcaaccgcagccgccgccatctcgtaagcttcattgtagctgtaagcgtaaaacagccgttccgcttctttcagctgttcggataaaatgtgattctggcttcggaaacggtttccgtactggatgatccgctcaataagcttcacctgaatcaccagttcttccgcctcttcactgacttccgcaaccatcttttcagcttcattcagatgtttggcggcttcctccatgtttaacggcagctcttccaattggctgacggttttttctatatgatgatttgccgtctcgagcttgtccttgacctgttcaggaatacccggcacattgcttttttgcagcattctcgctgtgtcagaaatggttttccgaaggtgcatcagcgtttcacgcgcctgcagttcttcttttctgagcgcttgcagattttcacggtattcggcatgttctttctgagcctcttccatctgcttttcgatggcctcaacttcttcaatcagcagagagtaagcgacatgctctccgtcaagtttttctctcgcctgctcaaggagccggccgatcgtttccatctgtttttcaaacgcatgctgtctgccgatttctcccgccgtcagctgatagctttccttgacgagctctgtttcggtttttgtgcggtctttttcttcctcaagcttctcatacgcgatgatcagttcaggcattttgcttaagacggactgtccggcttccacttcgccttccagctgttcatacatcgattgaattgtttcatcaatcagctgaagaatggcggacgcttcgtcgacatccaattcttccaaaagcgcgtgttctgcccgtttcacttgatttgtgagtgtctccagctctttttcgatttgaatatgttccagtttgtagcctttttccgtcatttcccggtagccgtctttcagcttggcaatttggttcggcacggtctgtttacagtccgcgagcagtttcggaacgtcatctatgtatgtttgaagctgatccagcctgcggtcctgttcaagcagcacttttctcgctttgatgtaattgccgccttccgtctcttcttcgaactcttttatgccgctccagatttcgtcgagatccgtctccaggctgttataaagctctccgtagagatggctgtacgccagaaggttcttccgcgcttttgaataccgctcacgcacctgttcaatctctccgcggcttttttcctcgctcgtcacaaggtcgctgatctcacgcaggatgccttctatatttgattcggcggcggtgaggagatcgtcgatgtggacaagcacctgattcgcttttttaaaccggtatttgtcggcgttctcttcggcatcataaaggagctcttctactttcggcagatgggctgtgacaatttcatcccactcctcgcgccatctttcaaagaactcttccgtctctccggtcattttcagatgtttgatcttggacatttcttccacaatcgaacggtttaaaatttcaatcttccatgactccagccggtcaatttccgtataaatttttttcctgaaaaagtagcccgccgcaaagagtgcgagcagtataaccaataatccgatgactaactccataatgagcccccttgttgttctcataatctgtcagggtgttttatgtattcagaaagatttcaatatatgtattgagaaaatctgtcgttttcattgttattatgataccatgtaaccaacattttttgaccagaaatcaaaaactttttgcataatttcggcaggattctgcaattttttaatggagtgacaaaaatggaaaaacgagacgctcatatccacacgcctttttgccctcacggctcgaaggacgcgctgaaacaatatgtcgaaaaagccctggaaagaggctttacatctatcacatttactgagcatgcccccctccctccgtcttttcaagatcctacaccgcttcgagacagcgcaatggctctcagagagatggaggcctatttggaccgggtctcacaattaaaaaaggtatacatgggacaaatcagcatcctgacagggcttgaaaccgattttatctcagggtatgaggaggaaaccgcggcgtttctgaatacatacggcccctcactggatgacggcattttatctgttcattttttgaaggccggcccgtcttatatatgcctcgattatgatgagcacgcgtttcagcggctcgccgcgcacttcggaagcattgaagcggtatatgagcaatactatgaaactgtgtattcttccattgtaacaccgctcggcccctttaagccaaaacgggtcggccatatcacactcgttaaaaaattcgcgcgccttttcccttacagcatgtcacctcaaataagagagcttgtgacccgctgccttgacgctgtgaagaagcacggaatggagctggatattaatacatccgggctcagaaagaagtttgccggggaagtatacatggaggattggatggcggagacggcgaagcaaaaaaaaatcccgctcatattcgggtcggacgcccatcaagcggaagatgtcggcagtttctatgaaacgtacaaaagcatcattacttcataagcaccgcatcaggccggcgaaacacgctttcgatccaaatcttcacctcttcaaaatactttttataaaaatacggttcatgaggctgcatatagagcacctccgtaatatattgtggctgaagatacggcatcatcaagagggatttcaattgcagaataaaatgcggcacgggcagcgtcagacgcctatcgcgtgactgcccttcttcgatcaccagctggaaaatatatttttctttcattaaataagtagacataatttccctgataagcacagaatcaatcgtcacttcccggtacacaaaccgcgttaattgacgatgatcgtgctgataggataaaatatcaaaaatcacccgcaggatgcgttcctgtgcgtcttcaccgttcatactgacggcggcgttttccagcgcctcagtgtagccttcgtaaaactcggaaactaaatgttccattaatccgcctttccctttaaaatagtaggagatgtgcgcaacatttacatcagctgactttgcgatttcacggacggacgtgccggaatagcctttttggttaaacagctggacagcggcgttaataattttgtctttggtgcttactttcatacggctcacccctttatgttaccaattcaagccgaagggcgccgttcctgtaagaacttctcgacaaatgccggcagaacggccggaactttgtttgatattatagaaaaagtgagggttttccatgtttcatgtcgaaaaacaatccggagataaagaaaaaagttatcagcttctgcttaaacagctcgaagccatgacagaagatgaaacagatgcgatcgcaaattacgcgaatgcgtcagcgcttttataccattccttacatgaagtcaactgggcggggttttactttgctaaagagggcgagcttgtgctcggaccgtttcaagggcttcctgcctgtgtgcgcattccgttcggcaaaggcgtatgcggcactgcctactctaatggcgcagtgcagcggattgccgatgtgcatgcgttcccgggacatatcgcctgtgacgcggcttcccagtcagaaatcgttcttccgatccgcgtaaacggtgaagtgatcggtgtgctggacattgacagccccgtgaaaaaccgttttgatgaaacagacgaatcctatttagcacagtttgttgaaacgcttgaaaaacgattaggataaaaaaaaggagttcggcccgcgggccggctccttttttacgtcgccgtgctgttttgatggatgatcagccggtttttaccgttccgtttggcggtataaagcgcctcatccgcttgctgaacgagcattttcaacggcatcgggtcagtctttgaccagcaggaaacaccgcaggaaatcgtcacgcgcggttcggtgttttcccggatggcgcggaccagccttctggcgatgcgttccccggatgatacgttgatattcggcagatagacagccagctcctcgcctccccatctcgcagcgacatcgtgctcccggatatggtttttcataacggaggccacctgtatcaggatcgaatcccccgtttgatgaccgtatgtatcattaatgtttttgaaattatcgatatcaacgaggatgaatacaccccgtttatgaattttcatgctgtattgaattttctcatccaaataggttcttgaatacagctccgtcagctggtctgtctgaacaagatgctcaagcctgtcgcgcagcatggagttcgtgaccgccaatgtcgcatggtgaatgagcgcctgaaaaagcttatacatttcaaacgtaaaagcgtataaatcctttttcaataaaatcgcgaatccgaagacggtgtcattttcgatcatcggcaccgccatcagcgaaccgtagccattttcgccgaatacagtctttccgctgccgataaacacacctttttctccttcgaacagcttttctttcacaatgctgatgtatgcgtccgcgcgttctgtcttaaaaaaggcggtatgcccgggaagcagattttgcgcttcaaaatggtcaatatgaaaaaaagccacttcttccgcatgaaacgattgaatcataatagcggcgagctcccgcatcgtatcagtgagcctgagacgctgattcagctgacgcgatgtttcattgatgagctcaagattcgcaatgctttttttcgattgctcatacagctgcgcattttcaaatgcttttcccgctgcgcccgcaagcagcatcatttcactcagagaactgcacgaaagcgcggcatcctgcagcccctcagccttcagaaccccgtaagtcccctgctggcctttaatcggcaggtaagcagatgacctgcctttcctgagcattctgcctgacaaataaaccttcagggcaaacggatcggcatcttctccgtccatatgcaattcttttgcggggagctgtctgtccgtatcctgatcctgcgagataaacagtaaaaaacggaaagactggaaagccttcctcaaactcgcctgcagtttttccaatacttcatcctgatctaaaagcgaatggaacatttctgtcattttgtgaattttccgctgatgctttgttttgtcaaacagcccgctttgtctcacagattgattgataaattgagtaacgagctcaggcaatgattccgggatcggaagtccgctttccgagcgcagataaaaggatctgccggacgtctgattcctgatcataaaacggccgtcactctctttcagcggagcataattcggttcctcttctgtttttatggtgaaacgtgttgattcagccggtgaaagggtcaatgaaagagatgtaaagcaggattcaagagctgaggccagccataacagcgagtcggataatgagacggattcagatttcgtcaagaaaaaagaaagcattttctgatgaaaggccgtaacttcatcgattgtttgttttttcatttttatcacctaaacatgtactactcatttttgtacattatatcataaaccgacagtcttcatggagaaatggttgacggcggccgggaaaaatcatataatgttctttgtgtgaaatattgcagcctttttgttcagcttctgtgttttcattttgttccttagctgtaaggtgtatcgtgtaactctctgctgctggagcgaggatacatgaaaacaaaatgtgcacggtcggatcgaacagacggtttttattttccacaaaataaaaccaaacaaaggaggagtcacattatggctcgctatacaggtccatcttggaaactgtctcgccgtttaggaatctctcttagcggtacaggtaaagaattagaaaaacgcccttacgcaccaggtcctcacggtccgggacagcgtaaaaaactatcagaatacggtttgcagttgcaagaaaagcaaaaacttcgtcacatgtacggtgtaaacgaacgtcaattccgcacattgtttgacaaagctgcaaaaatgactggtaaacacggcgaaaacttcatgattcttttagatgcacgccttgataacgttgtgtacaagcttggtcttgcgcgcactcgccgtcaagcacgccaattagttaaccacggtcacatccttgttgacggaagccgcgttgacattccgtcttaccaagtaaaacctggtcaaacaatcggtgttcgcgaaaaatcaagaaacctttctatcatcaaagaatctgtagaagtaaacaacttcgttcctgagtaccttacttttgacgctgaaaagcttgaaggtacattcactcgtcttccagagcgctctgagcttgctccggaaattaacgaagcgcttatcgttgagttctactctcgttaagtaaaacgctctttaaagagcattggattaaaccccggaaatgttgtgatgacaatgtttccggggtttttcttttggttgtgtaaactgcccccgtactcagccgtttatcccggagaatataaaaagcacccgttcatccgggtgctttttatcgtatttcattcttccatcacaccatactcagctgcggttcgaataattcgtagtggatcgattctggcggtgtattgaattcagaaatcagctttttcattgctttaatgaatgacggtgagccgcacaggtaaaaatcagcatctttatctgtcatcacttcttctaaaagccgcttgtcaatccggccttcccgaaaacgaatgttttctgaacggtcttgttcggacggctcgctgtaaataaagacagtgtcaacggatgaatgttccgcagcttcctcagcttcatgccgcaaagcatgatactctccgctccttgccgcatggatgaaaagaacatttcgctgcggctgggttttcacaaccgtttttaacatgctgatcatcggcgtaatcccgacaccggcactgatgagaaccaggttcttctttgaggcagggtccaatatgaagtcaccggccggggcgctgatctcgattgaatctttttcatgtaattggtcatgcagataagaggaaacaaccccttcttttttaacggaaatccggaaataatccttaccggacacgtccgataagctgtactggcggatatgcgtataacccgtgtccggaatgtatacttttacactgatatactgtcctgctttgaattcaggcagcggctgtccgtcttccggttttagataaaatgacgttatctctttgctttctcttacctttttatcaattttaaacggcttatagtctttccatccgcctttttgcgttgccgcttgttcatacatgtccttctcaattccgataaatgcgtctgcaattgcgccgtatgctttttcccacgcctgaatgacctcaggagtagccgcgtcctgtaacacatcctttatcgctattaacaaaaactttccaacgattgggtaatgctcgggcttaactccgatactccggtgtttatggctgatttgtttaacgacgggaattatgttttccaagcggtcaatattggcggcggctgcaatcacggcattcgataaggctgtacgctgggtttttttcttttgattcgtctgattaaaaatattcaacagctcagggtgatgctgaaacagcaggtcataaaatcgtcctgtgatttcttcaccatgctcttccaataccggcacggtgcttttaatgatcgcgattgttttttcatcgagcattctgaaatccccccaagatgtatgcatctcgattgactgaaaagaatcattttgaattcttttttatagatttccccggtcaaaaagaattaaccattccgatttgaagcgaattcaggaaaaccctgtagatactataaggataaaaacagcagataaatgcattataaaaaccaaacctgcggccctaaaaaatacggacttttctcagtgtacttgtccggtgcaaaatcctccttgtcagctatttagtacgggaggtgagataaatggggaaagaatcgaaagtgtattactgtgaccctaagtatgttgtggctgacacgtatactgacagcgaagcggtgtacgtccatcccatcaaacacattaacagagagcatatccgttatgctccccgtcacgtttatcattcatgagatcgttgatccgggcggtcctgggaaatgtgagtgtaaaaaaaataaaaaaagacacagatggtaattggctcgccttatctcaggttaaacacgcaagctaagcagacctccgtcttttcttgtgcctgataccgttgttatatacaaacaggcatgacgtatgagcaaaaaaatcgcagttctggtgacagaccaattcgaggatacaagcccggcagaagcagaaaaagaagtgaccggcaggcacggtgagaaagtaaaggtcgatcaagcgatctcagacgcagatgaattcgcagctgaacgcccggatggatttactaaagcatccgcaaagatttaataaataccggcacaaattttataaaggtgaagaagccggaagccatcatattttaacgagcagaaatgaatcgtgaatcattgaagctgctgaaataagcgaataaaaaatgcacagacagttcagtctgtgcattttttatggatatttaaactggacctattctctttaccatccaaaataagtaaaatagagagtgggtttttcaaaactcgacgggaggttcacttatgtggataatcattttgctgcttattattttaatcggctttaccggaaatattgtctcgcttttgagagcgcaacgacgcgcatctcaaagaattattgagcttttagaagaaaaaagccgaaaataaccttttcgtgctgtttcatccgtaatagtaataataatttcggcagatttcctgaaaaatgatttgatgccctgtctcgttcggatgaagaccttctgacatgcacattttgcggaaagcaggattatacgggtcaatgagatctgtatcaaacaggtcggcatacggtacagagaggagtgtgcaggcttctttttgggcttttacatagtccgccagcttcaggcccagtttatttttatcagtatcacggcggacgatttttccgtttgagattttcacctgccttgtcggggtcaccacaatgatgctgcagtctttatttctgcttcgcagctgctgaatgacctgacagaagcctccgtaaaatgtggtgatatccttttcatctgtgccgatgggaatatggccgcaccaatcatcatctgttccctgcacaataatgacatcatggcccgacgttttaagcgattgctgataaatgttatcggttccattgttgctcatattgacgccgctgacagacagattggttattgcagcgtttgtccggtctttcagaatgtcaccaaagccgtatttcgcacgcagcccccgggcgacgctgtcacctaagatcgcgattttcgaagccttccggagcctgcttatgctgatgaagtccacgctgacatgtccgctgtccgtgatatgtaactgcttgctgctgatgttctgcgaatataccgtttttccttcagattctttataaaaatcctcattcagcttcattcggtgtcatcccttcctttttatccttcggcatcatgttcagacatcaaaaacggacacgaacaaacagcgtcatgttgtcagttcagtgtccgcagatgatgatactggagtttttccagttctttctattgccattatagcagatcccggttctatacgcatttattgcacatcgtagtttttatagtcagcatttgaaacagcgcttgcgggaagagcggtgcttttgatgggaccgtcttgtgcgatgcgtacgacgtgtccggcgcgtccgtcttctgctgcgtgagcggtgtgaacggtgcgtccgtcttttgctgcgtgaacgatgtgaacggtgcgtccgtcttctgctgcgtgaacggcgcgtacattttccggcaaccggttcttggtgtaaatactcccctaaaccttctctttcagcaacggcaactccatgttcaatttctttaacagaaatagcgttcaattgtattcacctccctttttctttacaacaacttatgaaatgaacctttcacttgtataagcttctctctcatattggtgagaaatagtcatttacatatcaaaaaagccccgttttacacggggctctcagttaaagatcacgattatcgctgtcagaaacttgccggtgacaaaggcaagatcatttatttcttcctttcgctctccggctcaggatgaatcatcacctgtgcttgtttaaattcatccgtaatatccctttcaatgcggtcacacaagtcgtgcacgtctttaatcgtcacgtgagacgccacgaccatatgaaaatcaatatactcctgcgggcctgagcgccttgtacgaaaatcgtggatttcaataaattcctgatgaaatgtatcgataatctttaaaattgttttctcttcttcttctgacagacgggtatcaatcagcggcggaaatgcttctttcattaacttaaatgcttcatatatgatatacaccgcaagcaccatacctataatgggatcaagtatataccactccgttaatgtaacaaccaaaaggcttgccgctacgcctaatgatgtgtatacgtcagtcagtaagtgcagagcatttgatttcattgctacggaattaaccttttcagcttctctttttactaatttcgagacgatcaaattaatgagagcccctaaaagcatcacaataattcccaataccggcagatgaaccggctctggattcaccaatttttgaacgcattcatatatcatccaaatccctgccgcaaaaatcagaatcgtctcaatggttccggagagattctcgacttttccatgtccgtacggatgccctgtatcagccggcttttttgatatcctgacggaaataaaggcgatgaaggcggcgatcaaatctaaaaaagaatgaatggcttcggaaagtatcgcgacagaccctgttataatgcccaccgctattttgagcatgacgacaagagaattgcttataactgataaaaaagcgattttagaggtgttttccaccatgatcctcctcttttgacttcttgaatttatcgtatcaaacagcattcgtgtgggtctacggcaacgtttttcacaagagccatacaagtaactcgctctaaaataagttggaaagcgacaaaacagctgtgcctttcattcagcactcaagtcccattgacaacatataaccgcttaaattatagtagtttcatgaataaccactacggaggatgtttatggaggatgttctgaaagaattacaaaaatttggattttctcaatatgaatgcaaagcatatatcggcttgttaaaacactcgcctgttaccgggtacgaagtcagtaaaaggtcaggcgtcccccgctcaatgatctatgaagtattgggaaaattagttgataaaggcgctgtccatattgtgccgtctgatccggttacatatgccccgctggccggaaaggaattaattgaccggctgcggcacgatttcgaaagctccttcggctatcttgaggagaaattattggcgcttgaaagcgagcaggagatgaatgtcatcctccgcatcagcacaaatgatcatgtcatcaatgaattgaaggatatgattgaaaaagccgaggaagagttgtggctgtctgtctgggaacagcagattccctttattcaagaagccgctaacaaacgcgcggccgaaaaattgcccgtcttttcgattgtgttcggccctccggaagtaaagctcggaaatacgacacatcataatatgtcgcctgaagtggcggaaaaacgcatgggcgggagattaacgatagcggcacgcgataataaagaagtcttaatcgccaatttttctccgcagacgaatgcctgggccattaaatcagaagatcccgctcttgttctcgtggccatggaatatatgaggcacgaccttatgttcgcggagcttgtaaaagaagtaggggctgaaaaagttgaaggcctgatgaaacaaaaccattcgttatttcatgtcgtcaccggaaatcggttcatataaatgtgaaccgtattttctttgattttttcattagtcgttatcattataatctctaaggaaggagtataaaaaatgattaacacagaagtgcaaaaaaccgccgtttcccgggaaatgaacgatacatttttacagggggtccgggattgtgtgcctaccttgcttggctatatgagtatcggttttgcttttggcattgtcggcgtggcctcacatctcagtattcttgaaatttgtttgttatccgtgtttgtctatgccggcgccgcccaatttattatttgctcgctccttgtttccgggagtccgatttccgccattattttaacgacgtttatcgtcaatctgcggcaccttctgctcagtctgaccatcgcaccttatttcacgaaatactctttggtgaaaaatatcggcttcggtgctttgcttaccgacgaatctttcggggtagcggtaaacaaggcggctcagaacggcaggcttaacgataagtggatgaacggccttaatgtaacagcttatgtgtgctgggttatttcttgtgtgatgggcgggcttctcggacaatggatatctgatccttacgccctcggcctggacttcgctttgcccgctatgtttgcggcgctgctggtgctgcaattgcaggcgtctgcgtcggaaaagctgaagcacaatctttccttaatcgtctatatgatcatctttatggtcttgttatcctatatcgtgccgtcacatatcgcagtcatcgtctcaaccgtgattgtggcaaccatcggggtggtgacggacaaatgagcatcagtacgcaaatgatctggattatactcggctgcatgattgttacacttgtgccgcgtatcgttccgtttatatttgtccggaacattcagatgcctgaattggctttaaaatggctctcctttattccgctctgcattttgaccgctctggtaacggagagcatgatcgtgaaaacaaatagcgctttgacctttgattggaaagcaatgatcgttctcatcccgacattgctttgcgcgatgtggacaaaaagcttatcaattacggtcatcacgggagtcgtgctgatggccgccgtcaggctgatctggtgacaaataaaagcctccattccgcagaatgaaggctttttcctttatgatggcggattttcttcttccgcctcaggttcctcggctttgacttcggcgttcatgctttgctgctgttcccaatgatcccgctgcaatctttccttcgcgatggtgaacatgaaattcacggcgcagcgccccttccctgttttgccttatactatgtactgtactcatttcccggtgcagtattcacaaaacctaaaaaagcagcctgccgcataaagcggccggactgctttttattttcagtacgtgatcaggaagtattttttctttccgcggcgcagtacggtaaattgatcttcgatgcggtcttctgctgtcagaagatggctgatgtccgtctggcgctcgccgttaatgtagacggccccgttttgaatgtcttcgcgggcctgccgttttgaaggcgacaatttagattccacaagcacgtctactaaagacagctcttcagagcggtctttttcaaacgaaggcacgtctttaaaccctaccttgacgtcttgagcggaaagctctttaatattgccgctgaaaagcgcctgggagatatgaacggcctgctccagcgcttcgcggccgtgtacaagaacagtcacttcttcagcgagacgtttctgcgcttcccttttctcaggagccgtctccgttttttcagcataagcttcaatttcctcttttgacaggaaagtaaagtattttaaatatttgacgacgtcgcggtcatctgtattgatccagaattggtagaattcatacggcgatgttttttctttatcaagccaaatcgcgccgccttccgttttgccgaatttcgtgccgtccgcttttgtgacgagcggaatggtaagaccgaacgctttcgccccttcttcttccgattttctgatcagttcaagaccggccgtgatgttgccccactggtcactgccgccgatttggagtttgcagttcttttctctgtacagattcaggaaatcgtaggattgcaggatcatgtagctgaattccgtgtaagaaatcccggtttcaattcttgagcttacagtatctttcgcaagcatgtagttgattccgaagttttttccgacgtcgcgaagaaattcaatgatgctcatttttccgatccaatcaaagttgttcgctatgacagcggggttttctccggcttcgaaatctaaaaatcgggaaagctgatttttaattttttgcgaccattcgacaacgatatcctgagtgtttaacgtacgttccgcttttttgccgctcggatcgccgatcagtcccgttgcgccgcctacaagcgcaatcggatggtggcctgcaagctggaaacggcgcagtgtcaatatcggcagaaggtgtccgatgtggaggctgtcagccgtcgggtcaaaccctgagtataaacggattttttcttcgttcagctgtttattcagtccttcttcatccgtcatttgctggattaagccgcggaatgataaatcttctaataaattagtcattttgtcttctcctttgtttatagaaataaaaaacgccccttcgtttaaaacgaagggacgatataatcgcggtaccaccctactaataaaagcctaaaaaagctcttatcactcttcctgataacggaccgtgtccgttctttcactactgaaagccttcctttgaagtactttgttcgcaaaagcggttcatgagtgtattcggcatatcttatgtactgattttcaccggccatcagctctctggaacaatcagatatcctacttgtctcaatcaaaaccttttcgtatgaagcttactcatttttaacataaattagatgcaatgtcaacgccggctttaatcttccattgtggacaggtcgcctgccggcaggttcagctcccacgccttcaggacacgtcgcatgatttttccgcttcgtgttttcggcagtttatctttgaactcaatttcacgcggtgcggcatgcgcggcaagcccttgttttacaaagaggcgaatgtcctccttcagctgatcggatggttcatgtccttctctgagggcgataaacgctttaatgatttctccccggacaggatccggctttccgatgacaccggcttcggcaatcgccggatgttcaacaagtttgctttcgacttcaaacgggccgacacgctcgccggatgtcataataacatcatcgactctgccttggaaccagaaataaccgtcttcatccatataagctgaatctccggaaacataccagccgcccggcatgaaataagaatcatatttttctttgttattccaaatggaatccatcatggacggccagccctttttaatggcgaggttccccatccggtacggcggaagttcatttccttgattgtcaacgatcgccgcttccactcccggaatcggtttccccattgaacccggcttgatctccatgcaaggataattgcagataagctgtccgccggtttccgtcatccaccacgtatcatggatgcgcttgccgaatactttatgcccccacttgatgacctcagggtttaaaggctctccgacactcaggacgtgacgaagtgaggtaaggtcaaatttggacgccatttcatctccggcgcccataagcattctgaaagcggtcggagcgctgtaccagacgctgacaccgagcttttcaattgtgccgtaccagttttccggactgaatctgccgccgacgattacgttcgccgctccgttcagccacggcgcaaaaatcccgtacaccgtcccggtcacccaacctgggtccgcagtgcaccagtaaatatcgtcttctttgagatcaagcacccacttgccggtctggtattgctgaatcatggcttcatgaacgtgaagcacgcccttaggcgttccggtagaacctgatgtgtaatgaagcaggtagccgtctcttctgtccatccattcaatgtcaagtctcgtgctttccccttcagccgctttatcgtaatggatgattttatctcccgtttcttcgctgccgccgacaatgaaaatatgctgcaggtcggggagactctctgccggaatccgttcggccagctcaggtgttgtcacgacaacctttgcctggctgttcagcagacggtctttgacggcgccttccataaacgcttcaaataaaggaccggcaatcgcaccgattttaatagcgccgagcatgataaaatacagctccggcgaacgaggcatgaaaataaaaacgcggtctcctttttccacgtttccataccgtctcagcacatttcccgcccggttcgattcctccatcatttctttaaatgtgtatttttcttctctgtttgcgtccttgtaatacagcgctactttgtttctgcgaaatgactcggcatggcggtcaatcgcttcgtatgcggcattcagcttcccggtctgatgccaggaaaactcggcctctgcttctttccaatcgaagctgcggtatgtttcctcataattttgcagatgataattccccttttctgctggcaacgctttcaagttcatgcaacatccccctttgctgatctatagactaattatagtagaagttcacagttttctcaatttttaaaatataaattactgtactattgaaaacgctttataatttgttatgcttaaaggagatgtgtttttattaagaaccgacaggcggtgaatcagtgaaacatcataaaacgtaccattctacatctattcagacagcagccggccctcttttagtagaagggcccgttcctccagaggacttagcacagtatgagtttcatgaaggcctgacagcctttcgccttcctcatgaacagcacaaagcgttaatcgagatagccgggcttcccgaagggcggatcattatcgccagggacggacagacgattatcggctatgtgacgtatttatatcccgatccgcttgaacggtggtctgacggaaatatggaagacctccttgaactcggggcgatcgaggtcgctcccggctacaggggctgttctgtcggaaaaactttgctgacagtcagcatgatggatgaacagatggaacattacatcatcatgacgacggaatattactggcattgggatttaaaaggaatgaaaaaagacgtgtgggaatacagaaagattatggaaaagatgatgaatgccgggggtcttgtctggtttgcaacggatgaaccggaaatcagctctcatccggccaattgtctgatggcccgcatcggcaggcacgtcagtcaggagtcaatcgaacagttcgacagacttcgtttttatcagcgatttatgtattgactgacatacaaaggggataaaaaaatgattgcagaacaaatcatgaagcgggatgtcatcaccgtcacaaaaaacgactccattgaaacagccgtacgcaaaatgaaggcctatcatatccgtcatctccctgtcaccgacgaagacctgcacgtcgccggtatcgtcacagacagggacattaaacaggccggcccggacagcagctttgaacaagaagaccgcggcgcgtttctgacaaacaaagtggaaaccattatgaaacggaatgtcatctgcgcccatccgcttgatttcgtggaagaaatatccgcttctttttatgagcatggcatcggctgtctgccgatcacggtaaacaataagctgacaggcattttaaccaaaaccgatgtacttcggactttcgtcagcctgacaggcgcagcccagccgggatcacaggtggaaatcctggtgacggatatgacccaaagccttgctgatctcagctgcatgtgccgtgatcttcagctgcaaatcctgagtgtgctcgtctatccccatgattcagccggctcgaatatactcgtctttcgggtgaagacgatgaatccgctccctttcatccatgccgttcatgaggccggatacaatgtcttgtggccgaaacatttgagggatcagtcatgagagacagcgtttttgtttactcgccttcttatcagacatatcaatttcaccaggaacatccgttcaatcagcagcgcgtgcttttgacatacgatctgcttcaggcggcggacgcgtttgaagagggagatatcgtcgctccccgcacggcctctaaagaagagctggctctcgttcatacggaggattacatacaggctgtggaactggcgggtgcgggccggctccctgccaaagaaggagaaagctacgggctcggaacggaagacacccccgtttttgccggcatgcatgaagccgcatcgcttcttgtgggcggcaccttaacagcggccgattatgtcatgacgggacaagcaaggcatgcctgcaatttaggaggcggccttcaccacggctttcgcggcagggcatcgggcttttgtatctataatgacagcgccgtggccatccaatacattcagaaaaactacggggcaaaggtgttatacattgataccgacgcccatcatggcgacggcgttcaatttacattttacgacaggtctgatgtctgcactgtgtcttttcatgaaaccgggcgttatttatttcccgggacgggacaggtactggaaaaaggaagcggccaaggctacggctattcttttaacatcccgctggacgccttcacagaggatgattcctttcttcacgcttacaaaacggccgcctcggaaatcgcggctttttttaagccggatgtgattctgactcagaacggagcagatgcccattattacgatccattgacacacctgtccaataccatctccatttatcaagagatcccgcggctcgctcactcattggcccatcaatattgcggcggcagatggatcgcggtcggcggcggcgggtacgatatttggagagtcgtcccgagagcatggagccgcatatggcttgagatgaaagggattgatcccggggagcgcataccgcagaagtggattcaaaaatggcagaaacactctccctataccttgcccgctttttggagtgatcctgaccaattatatcctccgattccccgaaaagaagaaatctcagaaaaaaatgcccaaaccgtggaaaaagcgctttttgccatccggtctgagcagcggtataaaacaaaataaaaaacgaccttacgaggaggtcgttttttttatgacaatttctacacggcggttttctttcatatgtctgatgcttttgttgtccttcacaggtttcgtatccgcgtaaccgacagaaataaaccgtttggcggaaaagtcttcttttgcggtaaaataacggatcacactcgccgctcttgcagatgacagctcccagttcgacggaaattgataggtggaaatccggcggctgtccgtatggccttcaacctgtatggcattcggaagtgttttcaaaagcaccgcgatctgatgcaggactggctcagcgtttttcagcacatccgcttttccagtctgaaacagaacggcctcctgcagcacaagaaccactccgcgctcatcgcgcttcgccgtcattttggaacttaaatggtacgtttttatgtatgtcttcacgttctgcaacagcaaatcctgttcactattttcgtttgctttgcttgatgacgctggttcacccccgctgccgtttgtatgaatcgaagtaacggctgattgaaatttttccgcgtctatttgcgacatcgaaaaaagcaatataaagaacacgagaataagcgtgatcaagtcggcaaacgtcaccatccatcttggtgaacctcctgtatttcccggtttgttccttcgttcaaaacgctcttttctaagcttcatggacagcgccctttttcttgttcgaaggctgtcctttacgccagtcttctcttgagctgaaaacgacgagctgactttcgagattgcggggattttttcccgattggatgccgacaacaccttcgatgataacctgcttgatgaaaatttcactttcggttttttcttcaagctttgccgcgatagggataaacaccaaattggcaagcagcgccccgtacagcgtcgtcaatagcgcaatagccatattcggcccgagtgtatgcgggtcatttaagtttttaagcatgagcacgagtccgacaagcgtcccgatcattccccaggcgggcgcaaaatcaccggctttttcaaaaacgcgtctgccttttctgtgcctttcttccatcgcggcgatctctgaatccatcaccagccggatcgtttcctcgtcccagccgtctatcgcaagcaataaccctttttttaaaaacgggtctttgatttcacgcgcctgatcctccagagacagcagcccttgcctgcgcgcctgctccgcaaggctgacgaatactctgacaagctccttcacattatcatcctgacgggagaatacctgttttaaaacagatggggttttctttaaatcccgcggcggaaaactgataaacaccgctgcggcaaggccgcctgttacgattaaaaaagaagtcagatctaaaaatgagctgattcccgccagtcccgttcctgacagaattccgattgcgacaataatacagcctaacataaatccaacgggtgtcagataatcaaaacgtttcatatcttctccttatcaagtaaaaaagcaagattccactcaggcagagtgaagcttgcttttccgtttttcttatgacttggttgattgtcttaattcgatgcggtgaggcaattcaacgatatgctcttcaaccggctctttgttcatcagttttgtcaaaagtctcatcgccacggcgccgatatcgtacgtaggctgcacgactgttgaaagctgagggcggaccatcaggctcaatctcgtattgtcaaaaccgataatgtcaagatcgtcaggaatcgacataccctgatcctgggccgcatgaataatgccgagagccatttcatccgtcgcagaaaggatcgccgtcggtttccggtcaaggcccatcaagctttgaagcgcctccatcccggaatcataggtgtaatcgccttccgccacgaactgctcgttaaacgcaatgcccgcttcttcaagcgcccgtttgtacccttgcagttttttcgaacggttgatcggctctgccatcggtccggagacaaatgcgatatcgcgatgccccttatcaatgaaaagcttgacggcatcataaatcgcctgttcataatcaatggcgacagaaggcgtctcgccctgttcttcaactgacgcagccaatacgatcggaacgggagagcgcttaaattcttcgacatgctcgtccgtaatgttgccgcccataaatacgataccgtctacttgtttaccgagcatcgtatttaacaggtgcagttccttctcgagattttggtctgaattgcttaaaataatattatatttgtacatcgtcgcgatatcttcaattccccgcgcaagttccgcgtaaaaaatacttgagatatcagggatgatgacgccgaccgtagtcgtttttttgcttgccagtcctcttgccaccgcgttcgggcggtagccgaggcggtcaatggcttccaatactttttttctggtcgtcggttttacattcggattgccgtttacgacgcgggaaacagtcgccatgctgacatttgcttctctggccacatcgtatatcgtaatgttgctcactgaaaccactccttttactggatacacttatccttatctatagcataaacactttatgtaaagaaatgtcgtacgttttcgcattctgtcgtttatggttgtaagcgtaagtcagtagtgtacattatttttcattattcatcaaatttaaatacttctcatgaaattatacacgtttttcccaatgatgaaaacgttcactttcattttataattaaataaaatgaagaaacgaaaaaaggccgcacacggcggccttaaagagcggaacactgtattatgcttttactttcatcatcggctttaattcgttcagccatttctcgaattcaggaatatccatctgctgcgcagagtctgaaagggcaacggaaggatcagggtgaacttcagccataacgccgtcagcgccgatcgcaagcgccgcttttgctgtcggaagcaggagatcgcggcggcctgttgaatgtgttacgtcaacaaacaccggcaagtgagtttcctgcttcaaaatcggcacggcagaaatgtcgagtgtatttctcgttgctgtttcgtacgttctgattccgcgctcacaaagaatgatttggtcgtttccttgtgacatgatgtattcagctgcattgatgaattctgaaatcgttgcggcaagaccgcgttttaacaataccggctttttaacggaaccggcggctttcagcaattcaaagttttgcatgttccgtgcgccgatctgaatgacgtcaatgtaatcaatcgcttgctcaatgtgggcaggcgttacgatttcactgatcaccgcgaggtcatattcatcagcgacgcgtttgagaatttgcaggccttctacgccgagaccttggaaatcatacgggcttgtgcggggtttgaacgcgcctccgcgcaggattttaatgccttgttttttcgctgcggcagctacttccgcaacctgctcatagctttctacggcacaaggtccgacgatgaatctctgatcgccgtcaccgactttttcgcctttaatatcaacgattgtatcttctgcttttttcttccgggagacgagcaacgctttgctgtgatcctcttcttgaagctcgaggccggctttgaaaatttctttgaaaatatgctggattgttgagttttcaaatgggccgtcattgctctcaataatgcggttaagcattgtacgctctctgacagggtcaaatcggttgacaccctgtgcttcttttgctttaccgatttcttttacaacggctccgcgttcattgattaatttaaggatttctaagtttagtgcgtctgcctgctgtcttaggttctctaattccttgttgctcatctttttcatcccttctatgctatgttttattttaatagttaacatgcatcttactacagttatgcgaaaataggaatatgaaataataaattttttcacattctgctttatcacaaaaacgcttttaagcttttatgcgttgaagtaacgtataatgttatcctacatgatatgtctgaaatgatcaatagtttttttcaaaaaaaaaccgccggtattatccggcggcaagcaattatgaaagatgctgttctattgcgttttttgtaatttgtgaatgagacgcgtgccatttcacttcgccgtttgtaatgacgaatacttgcgggctttcatgtttcacgccgtaggtctcggcgatatagtttgaaagcggccggctgtcctgcacctgcaggtaataagaaggcacttctgtatgctccgatgcaaaggcgtcaaactcttgaaacgccgcttggctgatcgggcaggttgtgctgtgtttcaaaaacacgagcgtattttctttctcagcggcatttttgaactcttcttctgacgatatcagctgcttagtcatgtcggttatctctccttattgaagatcagcgatttgcctgaccggctgtttccgcggcttcttccgcttcgttcttgatgctttgagccgtatcctgcatttcgcttctcgtctcttcggctttctcagttagtgtgctcttagaacggtcttttaaatccttcactttattcataatctggcctgactgatcagctaccagctgggtgatgttagatgttttgtctttggcgatgctgacatattgagagcctttttctttcgcgtcggccgtcattctgtccgtcttatcctttaatgcagaggcctggctgccgagatcgtcgcgcagctccttgcctgatttaggcgccagaaacaaagctgttgtcgcgccgataattcccccgatcagcgttccgattaaaaaatccttactattgattccatctttgctcattatgattcctccttagtggatttttcttatgattaaagcgatgtttttttcttttgcttccacttgtcccatatttccatagccgcctggctccaggtgacaacctgactgatcttgtcctggttctctcttacagaggccgaaacggaaccggctgcctgctttatggatgtattaaactgctggacggaagttcccacttcctgcacagcatggacaaccgtatttaatttctctgatttttcctgaatatcctccgcgagacggtttgtcttatgtaacagctcggcggtctctgcggtgatgcccttcatctgcccttcaaggccgtttaaagtcgacgcaacgtttgttaaggtcatctgcacagactttaatgttttggacagataaatgacgaggataagaaatgctacggcaatgagtgcgacgcttaagtaaagaatgataatcatctaatacctccttattgcaggatataatggtatatacccaattatgaaaatgataaacatatatgaaaggggctgtctgtatactatttctccgtttatcggaaaatccctttacagcacgcgcaaaaaagcagtgagagccccactgcttttttgttacgctatgacgttttcataagctctcatatatttttgaatgtctccggcgcccataaagatcagcactgcgttttcatgcgcttttaacacggatgtgtcattctcttcaatgagttctgcgttatcgattttttcctgcagatccgtgatggtgagctttccgacgttctcgcgggctgagccgaaaatgtcgcacagatatacgcgatcggcggcgcttaagctttctgcgaattcatcaaggaaagattgcgtccgtgtaaacgtatgcggctggaataccgcgatgatttcacgttcaggatatttttgacgggccgcctcaatcgtgactttaatttcagtcggatggtgggcgtagtcgtctatcagcacctggctgccgatcactttttcattgaatctgcgtttgacgccgccgaatgattcaagtccgagcttaatcatgttcacgtctatctcttcatagtggcagagcgcaatgaccgctaatgaattgaggacattgtgatggccgtatgccgggatgtagaacgtatcgtaaaacgtattgcggacaaagacgtcaaatgtcgtgccttcggtattttttacgatgtttctcgcttgaaaatcgttttcttctcccgtgccgtaataaacgacaggcacattggcgtgaattttcggcaggtactcgtcatcaccgcaggcaatgatgcctttgttgacttgaagcgccatgttttggaaagcatcaaacacatcgtcaatgttggcgaaataatcagggtggtcaaaatcaatattcgtcatgatcgcataatcaggctgatagcttaagaaatgacggcggtactcgcaggcttcaaatacaaagtattcgctgctttcatttcctttgcccgttccgtccccgataagaaacgaagtcggcttcgcttgctgcatcacgtgtgctaagaggcccgttgtggacgtctttccgtgtgcgcccgttaccgcgacacttgtatattttttcatgtattcagctaaaaatttatgatatctgataacaggaatcccctcagcaagcgcctttgcgatttccggatgagaatcagggaatgcgtttccggcgattaccgttaagccgggtttgatgttatcggcgctgaacggatagatcgggatatttcttttttcaagggcagcctgagtaaaaatctgcttctcgatatccgatccctgcacctgatatcctgtatcatgcaagatttgagcaagcgggctcatacctgtcccttttattccaacaaaatgataaacagtcataatcgtacctccaacaaacgtctatctgttccccagtatatgacgctcatttcattttgcgaccgccgcgggcaaaaagcccaaacagcggcgcttccatttatttttacgttatcgtcagtatctgtaactttctttttgattaaacctgccgcatgatatttcagcgcgtgacagtgatgcagtttgatggtccatccactatcataccatgtttgtgagaaaaatgaacgatattcttattcttgagaaatgtcagcggccgtaatcagcacttcgcggggtttgctgcccttcgcttctgagatcatgccttcagcctccatcatgtcaatcagcctcgcggcgcgattatagccgattctgaaccttctttgaaggcttgaggtgctggcgctgttttgttccacgacgaattgacacgcctcaggaaacagctcgtcctcttccttgagggcggttccctgcctgatcagttcttcctgttcaaacaaataagaaggcggcagctgctttctgacatgggagacgacgcggtcaatctctctgtcggacacaaagttgccctgcaggcgcaccggttttccggtgccgttttcccagtagagcatgtcgccttttccgagaagcttttccgctcccgccatgtcgataatcgttctggaatctacctggcttgagacggagaatgcaatcctcgtcggtatgttcgctttgatcattccggtaatgacatcgacagacggacgctgtgtcgcgacaagcagatgaatgccgcaggctctcgctttctgcgcgattctggcaatgctttcttccacatcgttcggcgccaccatcattaaatcagcaagctcatcaatgaccacaacaaggtaagggagcttttcgccggtcttatgatcggccgttaattcattaaagcggccgatatctcttacacccgaatgggcaaacagttcataccgccgttccatctcttccacaacccattttaatgcggcggtcgcggctttggcgtctgtgatgacggggctgaccaaatgcggaatttggttataaggcgcaagctccaccattttcggatcaatcagaagcactttgacatcgctcggatccgccttataaagcagacttaccaaaatggtattgatgcagacgctttttcccgatcccgtggcacccgcaatcaatccgtgcggcatctttttcaaatcaatgacgaccgggtttccggaaatatcgacgccgagcgcggctgtaagcggagacggattctccctgaaagcggcgcttctgatcatctgccgtaaatcgacgaccttgcttacgcggttcggaacttcaatgccgatcgtgtttttaccggggatcggcgcctcaatccgaatatccttggcagataaactcagttttatatcatctgctaaatttgtaattttgttcactttcactccgggctcaggatgcacttcaaatcgtgtgacagatgggccttgtgtgacatgaacgacttgggcgcgcacattaaagtttttcagcgtaacgtttaaaagctcgcgctgtccttcaatccatgattggtcgtcctgtctttgcgccggcggcacgtccagaagcgacagattaggaaagacatagcccgcaccgccttctggcgtcttcgtctgcttgtgtttatcgcttttaagcatcatgacgttaaacggcacattacgctctctcggccgatccgctcttctcgcaggctgtgcggtgtgatcggttttttcttcagcaggccgggccggggcatcggccgtctcaatgtttacaggctcaagctccggttctgattgctgaggggcatcattgtactcaggctgaggatctgcttcctgtttcacgtcagcttcaggcaattcaggccggtcttcagactgcggctgaacttcttcttgttcttctgagtatgtatacaccggttcttccgcggtttcaaaaggccgggctttttccggctcaggctgctgatactcctcctgcggcggcgcttggtcttctgtgtgttcagccggcaggggtgcttcatactcaggttcttttatagatggctcggtttgttcatgctcttgttcttccggatagccggcaggcaccgcgctttccgtttgctgcgagtcttcagactgcggcggttcggacgctctgtacacctgctcttccgcttcagtctcagagtgcagctgctcttgtttggcggccgggtattcgtccgtttcctgtttcgttaacggttccggccgggtatttgtctgtttagttaggccggatgctgtgaatacgggctctttttccgtttcctgaccggactttggcggatcaaactgctcctctgacagcaatgttacgctctcttcacgctgtttttggggattaggcgcttttttaatgctgtgctgagattgaaagccgtagaccggtgaaggaatggatgacggtttaaagggctttttcaccgtatccggctctttatatgtatgctctttcctttccgtatgctccttcgcggcggcataaccccgtgaaggctggcggcggcgttcgtgcctttcctgctgtctttgttccgtccgcttatagccgtccggaacgacagggaagcggaaattccctttcggatattcataatatattttaggatcttccatgcgcgttaatttgccttctggctgatccggtatatgctctttcgggacttgtgcatgcgtgttcggttcaagttcatgctcttcttctttttcacctaaaaataagtcaaaaaatttattcagccaactcatgtttaatcactctctaactccctttttagtagtctgggacgatatttagtataccattgccgggcggctcagaaaagattaagctcccaacagaagaaagccgttaagcagacatgcttaacggctttccctcacatcattcgattctgtgcgcttatttatgggagttagaattgaaatgcttcgccggcctcgcggctgtcttcaagaacaagaatgcctttttcctgcggcgcatccggcaaagcgagttctttcgcggagcagatcatgccgcttgacggaacgcctcttagttcagcgtctttaatcacaagcccgctcggcatcaccgcgccgactttagcgacgacgactttctgtcctttgtccacgttcggagcgccgcaaacgatttgaagggtttcttctcccacattcacttggcagatgttcagtttatccgcattcggatgtttttctttcgattctacgtgaccgacaacaaatttcggagaaaggtcaaccgtcagtgtttctgaaacgccgtttctgttcagtatttcattcacgtcctgaacgaatgtctcagacaaagcgacggggccgttgtcttcaatctgtaaataagaagacacgttaaaaatgttaaagcccgtcgtttcttttgtttctttgttaaagattcttgcgacatcgccttctctttcatagctgatttcttcgcgtgctgcatctttaagagagatcagaagcgtatctcccacaccttctttattgtaaaaagcgttcataagaaaaatcctttctaatcctttttcggccggcttttcgccatgataaacacaggttccagtctgccttcattgtacagaaatgaaagggccgtaatcggcaccgtgccgcttgcaaagaagctcatggacatttgccctaaaatatcataacccgattcatttcgaatgtcagcaagtattaatacatcctgatgcgggacagaaatcgctaattcaccttcagcggcctgcttgtattcatgaagaatcgaatcattgagaatccggctggcgtcatagccgtcattcgccctgaaaaaataaaaataattgcccgcaaccgtatcctttttgacgacggaagggagagagcggagattgaatgacgccgtctccctgatccgttcttttgtccagttttctttctcaagcatccggctgtcaattaagcggtacgttttgccgaggtcaagcgcgtagtagattctggtttcggccgtatggtcatcatacacgagcggaatgccgtcgcccgtttgatcgggaaatgatgtggagcggatcaccggatagattccggcttcctttccggtcatctcctgtccgctgccgcccatcgcctccatcgcttctgacacatagtagacgatctcgtcgatcgcttcttctttttttgtctcccacttggcgatgatcggcgggagctccaatgtaatgccttttttagtcgtttgatcctcaacacggagggtgtctttttctctgtcaaaaaagaaggatcggttctcgtgctgcaggcgctgttttaatagatccgacagcttccttgacgtcattttcaaagcctgtggcctcctttacgctttagcgagggaatcggttaaaaattgctcaatttcctctttcgttttgcggtctttgctgacgaagcggttcacttcttttcctccgttaaacaccacaaagctcggaatgccgtagatttcccattccgcgcatgtatcaataaactgatcgcggtctacgtagtaatacgtgaattcaggatagtccgcttccagctcagggagaaacggctccacaaagcggcagtccgggcaccaatccgctgaaaacataaataccgcccaatcgtcctgtaccgctttttgcaattcttccgtgctttcaatttttttcattgtgattcctccatttggattttgagttttttgtatgctgagtccaattggatcataccagactgcttacagcaagaccaactatatgcaatatcattatcatatttcatttgcattatcaagtaagtttcgtttaccattttgtttatagccgtacgaaaatctgaatatgtataaaaggaggagcaaaagatgcagtttgtcgtgtacttagccggtgaaatccacagcaattggcgggacgagatcaagaacaaagcaaaagcgctgcacctgccgattacatttgttggcccgatggaaaaccacgagcgctcagacaatatcggagaagagattatgggcgagcagcctgattctgttttaaaagacgccagagcttctgatatcaacaatttccgtacagaggtgctgatggaaaaagccgattttgtgatcgccctgtttggcgagaaatataaacagtggaataccgcgatggatgcttcttatgccatcgcaaaaggaaagccgctcattcttatccgcccgaaagagctgcatcatcctctgaaagagctttccggaaaagcgaatataacggtggaaaccgtaaatcaagcgatgaaagcactctcttatttatttgaaacagaataagcaggccgcctttatgagggcctgcttatttttttacacattttctctgatcgtttcgaccgtctgtttgtcactcgccatgaccagcttaatgagcatttctttcgccgcggcataatcgtcgacatggatgatggcggcatttgtatggatgtatcttgaacaaatgccgatgacggcagacggaaccccgctgtttgaaatgtggacccttccggcatccgttcccccgcctgaagcgaagtattgataagggatattatgcgtttccgccatatcaaggacgaactctctcatcccgcggtgcatgaccgtcgttctgtcgagaatgcggagcagcactccctcgccgagacggccaaacagctccttatcgccgctcatatcatttgccgggctggcatcaagtgcgaagaagagatcaggctgaatcatgttggctgctgtctgcgcccctctcaagccgacttcctcctgaacggtggctccggcgtacaggttgttcggcagctcttttccgtgcagctcttttaataattcaatgcttaatccgcagccgtagcggttatcccacgctttggacaatattttcttctcattggccataggagtaaacgggcataccggcacgacctgctgacccggtctgatccccattctgaccgcgtcctctttatcatcggtaccgatatcaatcatcatatttttgatctccatcggcttggcgcgctgggcatccgttaaaatgtggggcgggatgctagaaatgacgccgatgacaggtccgttatccgtctgcacctcgacgcgctgggcaagaagcacctgactccaccagccgccgagcgtctgaaatctcagcatgccgttatccgtaatctgcgtcaccataaatccgacttcatccatatggccggctaccataacggtgggcgcatcttcagcgccccgccttacgccgaaaacacttccgagtctgtcctgcacgatgtcatccgcatatttcgcaagctcccgtttcataaaggagcggacctggtgttcatttcccggtgcgccgggaagctgcgtcagcgtccggaaaagcgttttcgtttcctcattcatattttcccctcatttctatgtagtgcttttattttattagaaaaacaaccgttttccaagttctcaaattgaatgggctgtaaaaccgccgctttacttaacaccgtctggcatcttctgtataataaaaactacgacataattggaggtgcttcatattgaaattacgtcattttctcttaggtgcgggagtcggattatgcgctgccatcgcagtgaaaaagtatgcaatgaaaccttatatctcttcagaaaaagcgctgcgcatcgtgaaagcggcttttaaacagcgcgggccgatagatggatcatggatatacacagagcccgagccttaccaggtaaacggagaaaccatccaggtatacaaaactggcgtgacacgttcggcatttggcgagctggagcaatatgaagttatggtcaatgcaaaaacaggccagattgtcgatgtcattgattctgtcgcctcataattcggacaagcaaaaaataaagcccaaaaccatcagcgttttgggctttattcggttacatcggccgaatccgtttgtatacagggtgccacatcgcgtcttgcaccgtttggatcagatcctcgggttccgtttccgctacaccgtcctgaatggccgctttcgctacggctaccgctactgttgctgataccgtcctgagatcctccactttcgggagcatcggcgcccccggcttgccgacgtcgaccataccggcaatggcattcgcgcaggcaacgaacatattgtccgtaatcagccttgctttcgtcacaatcgtgccgagcccgagtcccgggaatacgagcgcgttgttcgcctgtccgatatggtaggtaacgccgttatacgcaacaggagggaacggactccccgttgtgacaagcgcacggccttctgtccattttattaaatcttctggttttgcttctgataaagtggtcggatttgacatcggcaaaatagcgggccgcttgacatgagaggccatttctttgacgatttcttccgtaaatgcgcctgatacagtggacgtgccgatcagaatcgtcggcttcgcctggcgcaccgtctccgccagatcaattgatccgccttcaccgctgcggctgtactctttcacttcatcagcaggccgggcgtacggaacctgaaaatcacgcaaatccttcatgtcatccgttaacagtccgtttctgtcgatacaccaaaaatggctgtatgattcttcttggcttaatccgtcatgcaccattgcttcacggagctgctcagcaattccgatgccggccgttcccgcgccgaagacaacgactttatgttcttttaaaggcacttttgatgcttttgcgcaggctaacactgctgcaagcgacaccgcgcccgttccttgaatgtcatcgttaaacgtacagactttatctttataccgttttaatatgccgcgggcgttagccgtaccgaaatcctcccaatgaagcagcgcattcgggaacgtttcccgcgcaagcgagacatattcatcaataaaacggtcatatttctcgccgcggactcttgaatgctggtttccgacatacagcgggtcatttaaaagactttcttgatttgtcccggcatctaatacgaccgcaagcactcttgacgggtcaattcccgccgctgccgtatacacagcgagttttccgacagaaatggcgatgccgccgacaccccagtcaccgattcccaaaatgccctcggcatccgtcgcaacgattaaatcaatattttcattttttccgaactgctgaaatgcagtgcgcattccctcaggatcatctattgataaatacagaccgcggggttttctgtactcatggctgtaacgctggatcgctgtgccgacggtcggcgtatatacaatcggcagcatttcgcctaaatgatcatttagcagcctgtaaaataacgtttcattccggtcatggagagcggtcaagtacacatttttgctcagctcatcaggctgcgaactgaactgttcgtaagcccgtctcgcctgctcttcgattgtcaatattttcggcggcagaaatccctcgagtccgagttcttttctttcctcctgtgtaaaggccacccctttatttaaaaagggcgtagaaagcaattctaagccgcgcagggttgttttgatttctccatctttcgtcacttgaaattgattcacctgtctcttcctttcaaagcaatttgtcttaggtttgcttttattcccgaaattcatacaggtaaatcatttggcccgcttattttttctcccgcttgacagacgcagccacttcaccgtcttcgccccattttaccgctctgtaaatcgcgtcgtgatagaaaatcagccaggcgtctttctccgctgcgaacgtctgccatttctgcttttgcggaatcgaggtcatcggataatcatcatacgccagcacccataacggatttttatgagcgtttgtcggcatcaggtcggcaaaatgcacagccgtttcccctccgtcttctaagacaattacgctgtgtccgttactgtggccgccggtgtggtgcatcgtaatgccttctgtcagctgatacccgttatcaaaggtttcgacctgatcttgtaccgcctcccaattttctctccaatatgtatttttcgatctgatattagggtttctcatttcgtgccactctgtcgcagaagtgataatacgggcattcggaaaaacagagacaagctcatctccgctgtattccgtcagaccgcatgcatggtcaaaatgaagatgggtcatcgccgcaatatgaatatcctcacaggaaagccccagctcactgagagattttttcagattggattcctgtgttacgccgtaatttcttttctgcttatcggagaatttcccactgccgatacccgcgtcaaccaatatattcaggccgttttttctgatgagaatcggatctgttcttaattcaatctggttcttgtcatttacggggtattttctcgaccataaaggcttcgggacaacgccgaacatcgctcccccgtccatatgcgtcacaccgccgtccagccacgttaatgaaatattcccaatattcaatgtctccatcttcatccctcctgatgtaatggtagcaaatggcggcataaaaaaacagactcccgcatcagagtctgtcttttgttctccatttggcttccgcccggtaaatcggctggccgagcgcggagaatttttcttcgtattctgtcataatattgcccttcggatcgctgttgtgcagatcgagactgacatccgtcaggagcaggccgtattcggaaaagctcttcagggagtattcaaatagaccgcggttatcggttttgaaatgaatctcacctgtttcgcccattacttcttcgtattttttcaagaacgttttaaacgttaaacggcgtttttcatgacggtttttcggccaagggtcagaaaagtttaaatatacgcgtttgatttctccccgttcaaatacatcattcagtgtttccgcgtctatatttaacaagcggacattgtgagctccgctgtcctttactttttggacggcagtgacgatgacgcttttaaacagttcgataccgatatagttgatatccggattctgcttggccattcctgaaatgaactgcccttttcccgtaccgacttcaatatggatcgggttgtcattgccaaagaccgtgttccaccgccctttatactgagccggatcactgatggcgatgtcagcgttttctgccagaaaatcattcgcccaaggtttatggcgcattctcatatgattgacacctctatctataatttcgagtaacaacataccatgaaacaaaaagagccgcaagcgccttttaaagaccccggctgcataaaaaaagaggctccccggtccggaacactcatgtgatgcataaaaccgcaccgctttgcacaatgtatgacacagaaaggatgtgtatatgaatcatgggcttaacaagcgaacatcaggtccggttattaaaggacatattggccgaccatcaattggattgctgcgggaccgttgccgaatatgaacagctcgagcgcgtcatcaaatcactgatggccaacaccgggcttgattcaaatataaaaaacgtgctcgaggatgtataccgctacagccagtccggcatcacggccgattccatcgacacgcatattcaggagcaccaaaaccatttgtcccaatgggtggagcagatgaattcgtactcctgactacttgacaatccgcttcatcagggcatgaagctcttccatggcatcatgatacgctttgtcgtttccttttgatttgtgccaggcaatgaaggtgagggtctctgataacatgtaccatgccatccgcagccgcagcccttccgtgagcttcatgccgtacattccaagccagctgtcccacgctggctcttcgacgtaatgatacaataaagggccgagatccatggccggatcggctatcatggcgccgtcccaatctattaaatacagctggttgtcttcagacagaagccagttattatgattcacatcacaatggcagacgactttttcaccgaattgaacctgatccacatgcgcttccaaataagcaaggccttcctggataagaggcgaaaattgccgcacggcaaagacggcctgcttcagctgcgacaaaagggcgcccggatcgagcggttcttttcccaatcttttcagcatgtcgagcaaggctttggatgtgtggattttgcgaagcagctcagccaccgggcgtccgctcatatccttcggcttcagctctctgcccgccatccaatgctgagccgtaataacgtctccgttttccatccgtttcgtccaaaccagcttcggaacaatgccttcggcggataacacggctaaaaagggtgagctattacgttttaaaaaaagctgttggccgttatgtttcgcataatatgcatctcctgtagctcctccggcggggaagatctcccaatcgctacctagtaattgtcccaaccagttcatatcaatgttcaacccatcatttcttaaaatattttagaataggcctccagcctttctcttttcggcggagcagcctgtcataaacaatttcttgagaataaaaaagacagctattgagagtctcatatgctaatcaatagccgtcttataaattttagcgctacagcacaaacttcgtcaagcaaaactagcaagaacacctgtgaattctgaagatttatgtcgtgaaccgctctttgccgagatagatttgacgggttttatttgtttattatgtttttatttttaacggcgctccgcctggcataagccgaaacggcgtcgttccgacaagctcgccgtcagcgtgaagcggaattttcccatccgtttcaaaaatgaattccttcccctttaaaatcgtcactccgtccattttggtatgccggccaaagctcatcgcccatagaaaacggtacagcggaaaaaaggacaggttttctgcaatgacaatatcaaaatggttttcgcggggatttgcagaaggcgccgctttcataccgcctccgtaataaggatgattagccgcaatgacaaaccagacattgcggaattcatgcctttggccgtctgcggtgcaagcaaatctgaacggctgaaaccccgaggccgtacgtatatgcgcaagcgggtaaatcacaaaaccgagacgcagaaaccgaagaacgcgcgaaaacggaaactccgcggcagtcttcaagaccgaggcatcgaagccgacagacagatggttaataaaataaagagattgggctttgtcatgaaaaaagttgatgtttcccgcaaaaaatttccgtgtgagcgggcggtgcaggcctttgatttcatggaggagcgccgacttcttaatgccgaggcctttggaaaagtcattgtacgaaccggcaggcacaaaggtcagctcaatctgatccattcctttcagcccgttaatgacttcatgcatcgtgccgtccccgccgataacaaacagccgcttcagcttatgatcctgcatcgttgaaatctgtctcgccagcacttccgcatgtcctggatgcccggtcaaaaaggagcggtggctaatcccgcgcctggtcagctctttttgaaccgatttccagacacgccggccccgcccgcctcctgagaccggattaatgataaaaaaccattgactcatcgtttgttttcacctgcttcatagatgaagagacatctggcaaacgtccgttttaatcaagccattcctgtctcctgcttgattgactcaagccgtaagacaaaagagccttcgccgccctcagctggtggtgcttgatcggcgccgtatttttctgctgcttttccagccactctgcggcagtccgtttatcagctatatccagcccgtacggcggctccggataatcaatataagacgttctgctgaacaaaagcttcctgacgggaatgtcggcctgcttttctttcatgatttgcgaaacgaccgaacccgtccgattcaggctgagagacggatttaatacttggcgggtgctgccggaacccctttcttcccagaaacgatgttttgatccgatatatacactgtcttcttcagcttccataaaagcagcgcagaaaatctccagcggggagatgatgacgatgctcaattcgacggacgcctgctgaatttgaagaaccggatgatacatcacaaaataggaatcgggcagcttttgagccagcattcttaacatcccgtcccgcttgacttcctgcgaaagctcagacttttgagaaagcgtggagctcgcccattttaattgaaagtcatacagctgggctttgaaaaaagatgcgagctcagacttttgagacggaagattcccgaacagcgcctcatcttcctccggctcatcaaaccattggtgcctcttttcatttatatcggccggattttcttcttttctcttttttaagaaaattttttttcgggccggcgcttgatcggtttcaccgccggcagccgtttctgttgctttttcttcttttttccggtcaaactcttcaagaagggtctcccagcgttccttcttcagccggatatactggttcatatagtgatatggatcaagctcatatcttgatatgcagtcatgaattttgatgatttgtgccatgtgatttccccactccgaatatttgtttatgtcaattgaaactgtgcgatttcttcgtatttaggcgatctgtcaaggtgggtctgaaacaaggaaaaccggctgacggcactttgcaccctgccgctttcaaacggcacatcttccggaaacggccggtctcccgcccacttccgcgccatcgtcatgtgaggatgatacggccgtttttccacttgaaaaccggctttcaaagcagcctgttttgttttttcccgcaaatcaaagagcagttcattgtgttctggctcaaggtgaagcactcttggctgtctgcggtcgccgaaaacgtccagatgctgaaactgtacggtaaacggctgcactgccgacgcagcatctgcgagcagagccgatagttttgcaagccggtcttcatccgcggctccgagaaaaatgagtgtaatatgatagtcatgcggatgcacccattttttgaatgttaatgccggctcctttctggctgcttcccaaatcggttcagcaatgtcagccggaatcggaatgccgataaaataatgcggcaatgaaactttcatgcgaggatctccccctctttggttatggtgttattataaaacggataagcggagaggagaaccctgtccgcttattatgataggatattatgtaccgaacgttttatacagaaaggatgagccggccttgaaaatagtaaacagcacggcggaactgatcggcagcacaccgatcgtaaaactcaatcgccttcagccagaaaatgcagcacaggtctatttaaaattagaatcttttaacccaagcggcagtgtcaaagacagagcggcttacaatatgatcattgaagcggaaaaaagcggacatctaaaacccggctctgtcatcattgaaccgacaagcggcaatacaggcatcggcctggcgatgaacgcggcggcgcgcggctacagggcaatcctcgtcatgcctgacacgatgacgaaagaacgcatcaacctgctgaaagcgtacggtgcggaggttgtgttaacaccgggggcggaaagaatgcccggcagcattaaaaaagcgaaagaacttgccgaacagatccccggaagttttatcccgatgcaattcgataacagcgcaaaccccgatgcccaccgaaaaacgaccgccattgaaatctatcaggccgttttgcagctcaacaaaccgctcggtgcttttgtggcaacggcggggacgggcggaaccattaccggaaccggagaaacgctgaaagagcttttcccggatttgaccgtccatgttgccgagccggcgggttcccccgtattatcaggcggaaaacccggcacccataagcttgtcgggacaagccccgggtttattccagacatattgaatcaggacgtttacgatgaaattatgaaaatttctgatgaagatgcgtatacgacaacccggcgtctggcccgagaagaaggaatactcgtcgggccgtcttcaggcgccgcctgcttcgccgccattgaaaccgcaaaacgcctcccttccgagcaaatcgtcatctgtatgacggccgatacgggagaacgttatttatcaacggatttatggtcatttgaatgataaaaagggatgccgctttcggcgtcccttttgttatcacttggcaagctcataaatggcttgagcgtataaggcggttgaccggagaaggtcatcaatctcaatgtactcatccttttgatgcgcgctgtcaggcctgtcgggaaacagcggcccgaatgcgacgccagccgaaagggatctcgcatacgttcctccgccgattgaaatcagatccgctttctttcccgtctgcccttcgtatacgttctgaagcgtctttacgagcggatggtcggcagatacgtggtgcggtttgctgtctttaaattcttcaagccggaattcttcaacagacataaaggcatcacggatgactttgctgtctgaagtgacagggtaacgaatgttgatgccgagttccccttcctcacccttattgtatgtaaaggtgccgacattcaatgtaagctctccgctgatgtcatccctgcaatcaattttcagctttttgcctcgtgtatcattagaaaaatagtcactgacagttttgacaaagtgctttccggcctcatccagttccgctcgctcaaggcattcagcaagctttaagccggcatttatgccattatccggctccattgcgtggcatgatttcccgtacacccgaagcgtcagttttccattttctgaaaccgcttcaccttgtgtttttgattgctccagccagttgctgaaataggcgtgtacggcatcaagaccgtccccttcaatgaccgcttcagccgcatccggcaccatgttcaagcgcagtcctgaacggaatgacagaagcccgttttttgcgtcttctttatcagaagcgctttttgcaatgcgcagtgatgcgtctataattcctttttctgcgttaatgatcggaaaatctgcgtcaggggcaaatccgacatcaggcattttttcgtgtttgaagtagtggtccacacatctccaatcactctcttcatccgttccgatgatgattctcacgcgtttggataaaggcagctgcatgtctttgacgattttcagcgcgtaaaacgccgccattgtcggccctttatcatcaatggcacctctggcatatatccggccatccctgatgtcggctgaaaacggatcgctcgtccagccgtctccgggcggaacgacgtcgacgtggcacagaacaccgacgatttcgtcacccgtcccccactcaatatggcccgcatagccgtcaagattttttacggtgaagccttctttttcaccgaattccaacagtgaagtcaggcagtcacctacgccttctccaaacggccggccgggaccggctgttgattcgtccattacgctgttgatttgcagaaacttctgcgtgtcacgaatcagatcttctttgtttctgatcacttcaacttcccagttcatcacaaatcccctttcttgataaagacttgcaaaatgttgataaaacgaataatatagatgatgttttgaaaaaatgttcgtcattggaggtacttatgtttcatctcgacaagcatcaaacgacaataaaaagagaaattaccgcgggattgaccaccttctttacaatggtgtatatcattgtcgtcaatccggtgatcctttcaaatgcgggaattccgtttgaccaggtgttcaccgcgacgattatcgcttccattgtcggaactttatggatggctctcgctgcgaattttccgatcgccattgcccccggcatgggcttaaacgcgtatctcgcctttcatgtcgtcggcgcaggcagcggaattacgtatcagacagctttcagcgctgtatttatcgcgggagtcatctttattattttatcgttaacgcctttaagaaaacaactaatagaagcaattccgggcaatttaaaatacggaattacgaccggcatcggcttatttatcgcttttatcggcttacgccaatccggaattatcacagctgataaatctaatttagtcgcactcggcgatcttcattcgcccgccgtcattttaacgcttatcgggcttatcatcagtattgtactgatggtgctgaatgtaaacggcgctctgttcatcggcatggcgctgacagccgtcattgccttcttgaccggccagatccattttacaaaaggattcctttcattcccgcacctgccggaggggctgttgataacaaatccgttcggagccctcggggatgtcgtacatcacggtctgtatgccgttgtgttttcttttcttctcgttacgatttttgacacgaccggcactatgatcggtgtcgccgaacaagcgggattgatcaaaaacaatcagcttccgaatgccagaagagcgcttttggctgattcgaccgctacgacagtcggaagcatcttcggcaccagcccgacaaccgcgttcgttgaatcttcagcaggggtggccgccggcggaagaacgggtctgacggcgctgacgattgccgttatgtttgctgtttccatgtttttcagcccgcttgtcagcgtcttatcggaagtgtccgcgattacgtcaccggctctgattattgtcggcagcctgatgatgggagcggtgtcgaatatccgctggaatgaacttgatgaagcgttcccggcctttctcgtcattttggcgatgcctttgacgtccagtatttcaaccggaatcgcactcgggttcatttcatacccgcttgtgaaactcgctaagaaaaagtggcgcgaaatccatcctttagtcatcatctttgccgtgctgttttttattcagctttttattttaaacgggcattaagaaaaatccctttcctttttcggagagggatttttcacatataaagggcggaaagaatcgcggcaatgaggcaccaggcggaacagatgacttgaatgagagttaatgcgctgtttctcgcccgaaaatagtcatcactctctctcttgattccgcttaaaaccggtttgtccgtaatccggtcaaataaaagcgaagcggcgtaccggctgactagcatacataaaatgagggcggccggtttcagcaaaagcggaagaacgagaataagagccgtaaaagccgcggttaaaaggtaaagctgccggagatacccgccattacggatcagcactttaaaaaacaattctttccacgccgtatacgccgaccgttttgaaaagatatgctttgagccgggataaaaaaacggcttgctccgtcctttatttttcacattcggcagctgcacatcatgactgagcatcaaaacagaggccgcaaatgaaagcttgcgcttattctcctcaagcacttcttcctcaaaagctgataaagaatctgcctctttccaagtaacaagaacggagcagataaacaatatacagcctgccggccaaagccagtaccactcggcggcaaagcggatcatgaaaaacgcgcccgccatcataacgatcactttcagccagcctgacgtctgattcccgaatgtctgcctgctgttttttctttgccggtgcaccgctaatatcgcggtatggaagccgaacagacagcaaaacatacctgaatatgccgaaaaagtacagtcaccgtactggcgccataagggaaataacagcaccgcaagcactccccatttgatgaaagataggaacatcgaatacaagagcgcgtaccgtttcagctgttgcatcaaatgttttgcatgcaccaaaaacacgtgatccgcttccagcaaaaaggtatgaataaaccccgtgcacaatagcaggacactgaatacatacagccagtcccagcccaatacgccggccgccccatcaagaagccccttcccgttcagccattcagcatattggtaaacgacgaatgcggcagctggaagaacgatatacagcgcgaccgtccaatcaatgatcgtccggaacaccttccattgataccgccaataatgaaacatcctttgaaaaaacaaagcccgcccggtcatcgctgactgccccgaaccgctgaataaaagcaatctaacaatgaacggccccctgttctttcctgaagctcttctaacgcgccttgaagaagcagagcgccttgatccagcaaataaaaacggtcgcagattttttcggcagtatccagaacgtgggtgcacatcagaatacccgcgcccctttctttctcagcaatcagcatgtcggtaaacagcttcgttgagatcggatcaagtccgataaacggttcatcaatgatgtaaatatccggtttcgccaaaaacgcctgcatgagcatcagcttttgctgcatcccttttgaaaaaccggaaggcaattcatgttttaccgccgtcaatgaaaattcatcaagcagccgcccggcccgctcacgccatgctccgctttctatgccccgtaatgatccggtcagctcgagatgctcccagagcgtcagttcatcataaaaactcggccgctccggtatgtaagcataagatgaatcattccactcaatacacccttccatatcccgggacagcccgagaatcgcctttatcactgtactttttcccgcgccgttcgccccgattaacccggcaatttctctcgaattgaccgtaaaagatacatttgaaatcaccttcggcctgtcagcatagccggcggatacaatgtttgcattcaataagtctcccaagcttctcactcccccattttcatacggacacgtataaaaaaagtttcagtttccatactaataaaagcgggccaggcatagtaatgcaccaaggcggcacccaattggaaaaaattatcggcgcttattcctagattcgtgtcctccatatcgtgtataatggaggcagttaaaagagaaaaaacagaatgtctgcctttgttgcttattcgtacgaagttttagagtcgtgagttgtggtatatcaagtccatccgatcttatgatagggagtggttttttgaaaccttcaacaaatcgtatgctgactcggattaaatcagtttacatgttcattcaggaaaaaggccttgtgacaacacaggaactggttgatgaattcggcattacacctagaaccattcagcgagacttaaatgtgttagcatacaatgatcttgttcatagtcctagccgaggcaagtgggagacaacacgaaaaaaagtgaaaattacatcttaagcgaacaattacatagggcccttttcggcctgacatgctgcaaggcaaaggcagcgtctttgccttgctttttgttcctctatataaaaaacccaaaacaaatctgttttgggtttttctgatttcgattacatttcagcatctttcagcgctgcgagctcttcttctgtcagctcgcgaaattctcccggcttaagctccgggtcaagagaaacagcccccatcgaaagccgctttaaataagccacttcatttccgacggcctttgccatcagcttcacctgatgatacttgccttctgtaatagtcaaatgaatgaccgtttcatccggactttcggtaatcgttttaacggctgccggcttcgtcttatagcctccttcaatcacaacgcctctttccagatcgatgatgtcttccggagacagaggtgatgttagccgaacctcgtatgttttgggtacatgctttttcggcgaaagcagacgatgagcgagctgcccgtcgttagtcagaagcaaaaagccttccgtatccttatcaagacgtcccgccggaaacggttcgaaccgctgttcttcaggcgtcagcagatcaaccaccgtttgctggcggctgtcttctgtagcggacagcactccttgcggcttattcatcatgacataaataaactcacggtactctgccggctctccgtataccgtgatgtcctgtttatcgggatcgacatggattttcacatctttcgccggctctccgtcaatcatgacagcccctgccttgacgatttttttcacatcttttcttgagccgaatccgctgttggcaagcagcttatcaagtctcatcatgatcctctcctttaaaaagaaaagcccgcgataagcggactattcattattcctcaatgggcggaatgcctgcctcttctcaaaacgcggggcagacggtttccaaacattttctgcaaaaatccgattcggtacgcggcaaacatgtacaccgcaccgccgacagcagcacagacaaagacgacaatcgccgcatgcagctggccgctttggtacgtgacgaaaaagccgagcagccattgagtcagcttgaccgcaactcccatcacgacggataagaccgcaattaaaatgacccgtttcataagcactgtatacgaatagcccgcatggcgcttaatcatgataaaaccgtacagtagagaagcgatataaccgagcgccgttgccaatatggccccgtctccctgaaacagcttgatcagcggcacgttcagcaccacttttataatgacgccgatgaaaaggctcacgacagcaaatttctgcttattaatcccttgcagaatcgcggcgtttacggtaaacagagaaaacaaaatcgcgacaggcgcgtaccagaacaaaatatcctgtccgatatccgggcgaaggctttcagagccgtagaagaacgtataggccggccccgataacacggacatcccgacaacggcgggaataaccaaaaacagaatgatctgcatcgtctggttaatctgctggttcaaaagcttataattcctgctcgtaaatgattcggtaatcgtcggaatcagtgtcaggccgaatgcggtcgccagtgaaaccggaatcatcacaagcttcggcacataaagagtgacaattgccagcatgtcctggctgatgtccttatggcccgccgcaatcatcgctttattaaacgtattcgtatcgatataagaatacaaaggaatcgccaggccgacaaaaacgtaaggagctgcatagctgaaaagctcaataaacatttttttatagcttaagtttgcggacgggacgaggttcggcttcatcgccagaagatcgcccttccgcttattccagtaaatataaaggacgacaagccctccgaatgatccgatcagcgctgcgaaagtcgcatatccgactgcgatgacaaggccgccgttaatcactcttaaaatcaaatacgtcgcgcccaataaaaagatgatccgggcaagctgttccacaacctgagaaacggctgtcggccccatcatctgatggccttggaaaaaaccgcgcacaagactcataatcggcacaaccaaaagtgccagactgaccatccggatgacataaacgacgtggtcaatcgtaagtccgttattactcgtgccgccgagagatgtttccgcaaaaaacggcgccgaaatataaagaatcgaaaaagcgatcatcccggtaacgagcataaccgacattcccgctctcagcatacgcctgctcgtttcatagtctcctttggaattatatttcgagacaaactttgaaaccgcggcgggaaatcccatcgtggcaatgtttaaaaacagtgtatattgattatatccgtattgaaacaaagctccgcccgtcgctccgaccatcgctccgaacgggatcagataaatcatccctaaaatccgcgatatataggtgccgagcgtcagcacgaacgtgccccttaacaatttgcttgacatgtttcctcatcaccattttctacgaagattcaacttttctattttaacacaactgggcaaatagacggtaataattacagcggaaaacttcttgggaaagctctaaaaaaacaaaatacgtttaaggaatcccctactttcgctataatagcaggaagcggacatttccgcctattattacgcgaaaaagaaagttgttgatgaaatatgaaacattttgacgtgattgtgatcggcggcggcccgtccggtttaatggctgcgattgccgcaggcgaagaaggggcagatgtcttattaattgataaaggaaacaagctgggacggaagctggcgatttccggcggcgggcgctgcaacgtaaccaaccgcctccccgttgaagaaatcatcaaacacatccccggaaacggccgcttcttatacagcgcgttttccgaatttaacaatgaagatatcatcgccttttttgagaaactcggaattcagctgaaagaagaagaccacgggcgcatgttcccggtgacagacaaagcgcaaagcgttgtcgatgcgcttttgaaccgtttaaaagaactgaatgtcaccatccgcacaaatgaaaaaatcaaagaagtgcggtacgagaacggcagggctgcgggcattacgacaaacaatgacgaacacatttccgccggcgccgtcattatcgccgtcggcggaaagtcagtcccccacaccggcagcaccggagacggctatgcatgggcggaagcggccggccacaccgtgacggaactctttccgacagaagtgccggttacgtcctcagagccgtttattaaacaaaaaacacttcaggggctgtcccttagaaacacggccgtcagcgtcctgaataaaaaaggcaagcctatcgtcacacatgtgatggacatgctgtttacccatttcggcttgtcaggccccgccattctccgctgcagccagtttgtcgtcaaagaactgaaaaagcagcccgaggtcaagctccgcatcgacctgttccccggcatcaacgaggaagatttatttcagcggatgcataaggagctgaaagacgcaccgaaaaaagcgctcaaaaatgcgctgaagccgtggatgcaggagcggtacctgcttttccttctggaacggaacggtcttgatccgcaaatcagctttacggagctgccgaaggatcaattcagggcgtttgtcaaagactgcaaacaatttacggttgctgctgacggaacgctttctctggacaaagcgtttgtcacaggcggcggtgtttccgtaaaagagattgaaccgaaacaaatggcgtctaaaaaaatggaaggcttatatttttgcggagaaatcctcgatattcacggctacacgggaggctacaatatcacctcagcccttgtcacggggcgcctcgccggcttgaatgcaggacgtttctcacactcgctgtaagatggtctaaagcacatttacctgagcgcccccattgaaaattgaccaaaaacatgatagagttttctgcgttttgtttcacctgattgagggaataggaagaaaggaatgatctgcaatcgtacgaccatactaaaacaaaatggcgtatcgaaaaaatagtcagagggtgagaacgtttgaaaaagaagaatatctccagtgttttttggattgtgattgttatcacagccgctgcggttttatggggtgtcgtttctccggacagcctgcagcaagtcactgaaacagcgcaaaatttcattacggattctttcggctggtattatctgctggtcgtttctatatttgtcggtttctgtctctttctcattgtgagtccgatcggcaacataaaactcggaaaacccggggaaaaaccggaattcgggttattatcatggtttgccatgcttttcagcgcgggcatgggaatcggtttggtattttacggggctgcggaaccgatcagccattacgccatcagctctccctcaggtgaaacagaaacgccccaagcttttcgtgatgcgctccggtacacatttttccactgggggctgcacgcttgggccatctatgcggttgtcgctttatgtatcgcatattttcaattcagaaaagacgcgcccggtttaatcagcagcacactgacaccgcttttaggcgataaagtaaacgggccgatcggcaaggcaattgactgtatcgccgtgtttgcgaccgttgtcggtgtggcgacaagcttgggtctcggagcgactcagatcaacggcggtctgaattatttattcggcattccgaagacattttccgttcagctgatcctgatcgttgtcgtgaccgtgcttttcttgatttctgcgtggagcggaatcggcaaaggaattaaatacttaagcaataccaacatgatactcgcgggtattttgatgatctttatgctcattgcaggcccgacggttttgattatgaactcatttactgattctatcggccaatacatccaaaatatcgtgcagatgagctttcgcttgtcaccgaatgatccccaaaagcgcgaatggattaacagctggaccattttctattgggcctggtggatttcctggtcgccgtttgtcggcatatttatcgcccgggtttcaaggggccggaccatccgggaatttttaatcggtgtgttagtgacaccttgtatattggctttcttatggtttgcaatcttcggtgtatccgctatggatcttcagcaaaaaggcgttttcaatgtcgccggaatgacaacggatacgatgctgttcggcgcactcagccactatccgctcacaatggtgacatccgtattaacacttgttctgatcgctgttttctttattacatcagcagattcagcgacatttgtgcttggaatgcaaacgtcttacggctcattggacccgtcaaatcgggtaaaaatcacttggggcatcatccagtccgccgtagcagcggttttattatattccgggggtctggccgcactgcaaaacacggccattctcgctgcggtcccgttttcagtcgtgatccttctgatgatcgtgtctctgtataaatcattagtgagcgaaagaaaaggaatcaaacaagcggagaaataccaaaagccgagaagtccccgcgtcaaaaaagcataatgcacaacgaagcccggcattcgcccgggcttctttactttcggtataaaatgagagcggaaaaacaataaagctgctccccttcaggatcacaggcagccgctaccgtatatttaatatcgacgagctgttcttcggaaattccttttaaaaatgaattgacttcagtctgcagatccttttcatgctcctcatcaaaaacagctatcttcagcatgtcaccctctcctttctctatcaatttattccggttcaactgaaatatgatagagaaaaacagatttccctttttactgatttttactaaaaaactccaaaaaaagttgttgaaaacgcttactaacatgtgataatatcactctaacaataaccaggtcatttctatttagtaaatttttagtaaaaaggagatgcgaaatggtccgtctcaaagatattgccttacaggcgtctgtatccagcgccacagtatcgagaattttaaacagagatgactctttagccgtgactgaagaaacaagagaaaaagtcctgcggatcgccgatgagctgggctatcagccgtcggcaaaaaaacgaaaaaaccgcagccgcaatgattctgcccccctgatcggcgttgtcagctgcctgtcaccggaggaagaacggcaggacccttatttttcggcgatcagaaaaggcattgaagaagaatgttttcagcaaaaaattttcatcacttcttctatccatctcggttcttttcaagagcatatgtttcacgaattggacggtgtgatcgtaatcggcagcctccaagacgaggcgctcacgaatatcagcacctctttcagacacgccgtatttgttaacggcatacctgatcccgcccgctacgactccgtcagcgtagacttttatgccgcagcgcagaaagcgatagaacatctgctgtcgctcggttatcggcggcttggttatatcggcggccgggagcgggagcataccgtgatagacggtgtaaacagcaatcaaacaattgaagataagcgcctgaccgctttcttacaaatggccggcgccgagccggagcacgtgctggtcggcgaatacagcatgcacgaaggtttccggctgatgaaggaagccatcaaaggcggcagtctgcccgacgccttctttattgcaagtgattcgatggccatcggcgctttaaaagccctgcaggaagccggccttcaagtcccgcgcgatacagcgattgtcagcttcaacggcattgatgaagcggaatacgccagcacgcctttatcaacggtaaaagtatatacagaagagatgggccggacgggtgtcaaattgcttcttgaccgtttgaacggcaggaccgtcccgctggccgtgacgctccccacttcactgattgtcagacaaagctgcggatcacaagaaaggaggtgacgtttcccgcagcatttatatcatatttaaaggaggaaaagatgaaacgcttactggttttgtttctttcttttatttgtatgatacttcccggctgttccgcgggacagagcagcgcaggagaaaagcagaaaaccttgaccgtctattccactatatcctcagacagcgaacgcgccgtgttcagagaattggctgattcattccaaaaagaacatccgggcattcaagtaaaagttcatttcccaggcaatgactacgaaaatatgatgagagtcagaatggcggccgatgacatgcccgatctattcgacactcacggctgggccaaaatccgctacggagaatatacagccgacctcagcggcatgtcttggacgaagcggctcgatccgaatttaaacagcatgctcaaggacgccaaaggcaggatatacgccttccctctgaatcaggcaaaggacgggcttgcttacaaccgcacccttttggaaagatacggaattaaaccgccggacacgatggacgatttcatgaaggcgctgagacaggttaaagaaaaaagcggcggaacagtcactcccttctggtttgccggctatgagaaaagctcatttgcccaatattacgatcaattcgccgcaccgcttctcatcacagatcccgctcaccgttacaaaaagcagctgttaaacggaaccttccgctggacacacttcacctatttatctgacaaactgaaagagatgcaaaaagaaaacctgctcaatacggatgccgtgacggcaaaacgttcccagctgattgatctgatggcgcaaaacaaaatcgcctttacgctgcagagcggcaccctcggccaagacgtcgctcaaatcaatccgaaggtaaaagtcggcatcataccgaccccggcagtccacaaaggagacgcaccggtatggatcgggggcgaacgttatacgctggcggcatccaaggattcctctcggctgaaagaagcgaaacagtttatcgcatttatggcccgtccagaacatgcaaaatcaattgccgaagcgacctcgcttccggcaggattagtgaatgtaaagacggacattttttacgcaaatgactataaacgctatcagcatattaaggtgcagccttatttcgaccgcctttatttgccgaacggaatgtgggatgtgatgggcacggccgggcaggagctgatggctgatatcttaactccctcagaaatttcggcgaaactcggcagggaatataagcggctccgtcttcaatctgattcacagggagctgaagaagaatgagtgatcttgcaagagaaaccgccggatttcaaaataaaaagccgattaaacccgcgtcattatggtggatgtacgtccctgctcttgccacggtttttattttcatgatttttccgtttgccaaaggcgcttttatcacatttacaaactggaacggcttctcacagacatatcaatgggtgggggtcacccaatataaaaggcttttgacagacccggacacatggctcgttgtgaaaaacactttgctttacgggctcggaagcactttttttcagaatatgctcgggcttttatatgcgctgcttttgaatcaaagcttaaaaatgaaggcgctcacaagaacgatcgtctacctgcctgtcattatcagtccgctgatcatgggatacatttggtattttattttctcgtatgacgggggcgcgctgaatgatgtgcttggcgcgttgggtatcggttctgtcaacgccttggcaagcccggcggcaaacccgtggatcatcgtcatgattaacacctaccaatacgcaggcattgcgatgattgtatatttggcgggcctgcaaagcattccgaaagattattacgaagcggcaaaaatagatggcgcgggaggccttcagccgtttttcaccattaccctgcctttattgatgccggctgtcaccatcaatatggtcatcaatatcatcggaggactcaagctgtttgatgtcattttcgccctgaccgcaggcgggccgggcaattcctcccaatcgatgtcgacatttatgtatgatttatattttaaacggcaggatgcgggatatgccgccgcccaaggcgtgtttatgtccgtcattattcttgtcatcagcttttcggctctcgtgtatttcaaacgaaaggagacggaaatgtcatgaaaacagtccgaatgcggatctttaccctcttggctgccgtcatctcatgcgttcatattgtccccttttatatattgctgaccacgtcattaaaagcaaaaggagactacagttcaaaatggtcgctgccctccgctttttcatttcagaatttccgtgaagcatgggagcgggcctctctcgggcaatcttttctgaacacgatcatcattacagccgtttccgccgctttgttaattttcatgggttcgcttgccgcatatccgctcgcaagaagaaatacgaagctgaataaaatcgtcttcggccttttgatttcaattatgatcatcccgcctttgacttccatggttcctttatacaagatggtcgctgatgcgggactgatcaatacgcatgccgcagcgattctcattaatacggctgcatatatgccgctgaccgttttcttatattcaggatttatccgctcttccattccgaaagagcttgaggaagcggccaagatggacggcgccggattgatcaggactttttatacgatcgtgtttcccctgctgaaaccgattaccgcaacggtctgcattatttcctgcgtgtttatctggaacgattatcaatttgcgattttctttttacaagatcaaaaggtgcagacgttgaccgtggccatggcgggattcttcggcgaaaacgcgaacaatcttcacttagtcgccgcagccgcaattatggcgatgctgccgatggtcgttttgtttttggcccttcaaaaatattttatctcagggctgtcctccggggcagtcaaaggctgagaagaaaagggaggaatttctgttgaagaaaattacgtttatcggagcgggaagcacgatatttgcgaaaaatgtactgggagactgtttactgactgaagctttaaacggatttgaattcgcgctttatgatattgatgctgtacggctgaaagaatcccagctcatgctggaaaacatgagagaccgctataatacgagcgtatccatcatttcttacgatgaccgaaaacaggcgctaaaacaggccggctatgtgataaacgccattcaggtcggcggttataaacccgcgacggtcattgactttgacatccctaagcggtacggcctgcgccagacgattgccgataccgtcggaataggcggcattttccgttcccttcgcaccatccccgttttatttgacatcgctaaagacatggaagaggtctgtccggatgcgtggctgttaaactatacaaatccgatggcttctctgaccggcgcgatgctcagacatacaaatgtaaaaacggtcggcctgtgccacagcgtacaggtctgtacaaaagatctgtttgactcactcggcatggatcacgaaggtacggaagaacgcattgccggcatcaatcacatggcttggctcttagagatcaaaaaagacggaattgatttgtatccggaaattaaaagacgcgcccgcgagaaacaaaagacgaaacataatgacatggtgcggtttgagctgatggataagttcggctgctacgtaacggaatcatctgagcacaatgccgaatatcacccgtattttataaaaagccggtatccggagctgatagatgaactccagatcccgctagatgaatatccgagaagatgcgcagaacaaatcaaaaactgggaaacgataagagacggcatcatcaacaatcaaaacctgacgcatgagcgctcgaatgaatacggttcgagaattatagaagcgatggagacgggccgtccgtttatgttcggcggcaatgtgctgaatacgggactcataccgaatctgccggcgaaagcagtcgttgaagtgccttgcgcagccgttaaaaatcaaattatgccttgctattcaggcgaacttccggaacagctcgcggcgcttaacagaacaaacattaatacacagcttttaaccatcgaagcggccgttactttaaaaaaggaagccgtatatcaggcggccatgcttgatccgcatacgagcgccgagctttccatgaatgacatcatctctttgtgcgatgatttatttgaagcccataaagactggcttccggcgtatcactgatcattcgcgatccggccccggagggggctggatcgcttttatatgttcagcaccagtttgaccgtctgcagggtgtgtcctttaaagtcttcttcaaattcacatacccggtgaaaccctttcgcttgataaaaggacaaggcggtgcggttctctttttctgcatggacataaagctcttttattccggcagactgtctgatacattctttaaggagtgacgtgcctatcccgtttccctgaaaacccggatcaatataaatagcggtcagctccgcttttccgtctttttgaaccggagtgacatttgcaaagccgagtacttttccctcttttccttctgcaacaaagaacagagaatgctgaagccggcgttccatcatttcatcctgataggcggatttgagaaactgatcctgaatgtgtctggggataatcccttcatacgtatgatgccagcttcgttctgcgacttgccggacctgtttgatatcacttgctttcatagcacggatcatcggtttcacttgattcgcctcccgtttttttctattaaaaaagaagaaaaagacgtacgttcctttttcttctttcactacaaaacgttatttcttcggctttgtttcgccttcccactccagcatgccgccttcaacattaaccgtacggaagccctgctcatgtaaatacatgcaaacattcatgcttctttttccggaacggcagataaatacatattctttgtccttgtctaacgcatccatcttctcagggatgtctcccatgcggatatgaacagcctgcggaatcattccttcggctacttcttcatcttctctgacatcaatcagatacagctcttctcccgcttttaatttctcttccagtgcggctgtgctgatttcatttattttcaatgtgtgacactcccattcgtcttaatgattttaagtataccaaagcctgcggggcaatttctatgctagaggcctgataaaaaaacccctctttttatgagaggggcttcgcccggtcagtttgccacaatattgacaagcttgcccggtacggcaatgatttttcggatcgtttttccttcaagctgctctttcactttttcgtcagcttgtgcgagctgttctaatgccgctttatcggcatcagccggaaccattaatttcgcttttacttttccgttcagctggacgacgatttccacttcatcatcaaccagttttgattcgtcataagcaggccaagcttcatatgcaatcgaaccttcgtggccgagtttttcccacagttcttccgccaaatgcggggcaacaggagaaagcagcttcacaaagccttccatatattctctcggcagttcattcgctttgtaagcttcattaatgaagaccatcagctgagaaatgcctgtgttaaaacgaagggcttcgtagttttccgtcaccttcatgactgtttcatggtagacgcgttcaagagtttctcccgcgccttctgtcactttgccggtaagctctccgttttcctcgataaacaaacgccatacgcggtcaaggaagcggcgggctccgtcaaggccggattcagaccaggcgatagatgcgtcaagcggacccataaacatttcgtacaggcgcagcgtatctgctccgtgagacgccacaatttcatccggattgacgacgtttccgcgggatttactcattttttcattattttccccgagaatcattccttggttatacagcttttggaacggctctttcgtcggcacgacaccgatatcatagaggaatttatgccagaaacgagcgtacagaaggtgaagcacggcatgctccgctcctccgatgtagatatcgacaggcagccatttatccagtttctcaggtgaagcgagctgatccggatttttcggatcgataaagcgaaggaagtaccagcagcttcccgcccattgcggcatcgtgtttgtttcccttctgccttttctgcccgtttcaggatcagtgacttccacccactctttaatgttggcaagcggtgattcaccggttccgctcggtttgatctcatcggttttcggcagaatcagcggcagctcttccgcaggaacggctgttgacgtgccgtcttcccaatgaatgaccggaatcggctcgccccaatagcgctgacggctgaacagccaatcacgcagacggtatgtcacttttttctcaccgtttttcgtttcttcaagccaggcgatcattttttcaatcgcttccgctttattcagtccgttcaaaaagccggaattgacatgctctccgtctcccgtgtacgcttcctcgtctgtgtttccgccttttacgacttctttgacaggcaggctgaacactttggcgaattcaaaatcgcgttcatcatgcgccggcacggccataacagcgcccgttccgtaagtagcaagaacataatcagctatccagatcggcagcttttcaccgtttgccgggtttacggcatatgcgcccgtgaagacgcccgtttttgttttcgcaagatccgtccgttccagatcacttttcgcctgaacttctttaatataagcgtctaccgcttctttttgttcagccgtcgtaatggcttcaacaagctcatgctcaggagccagaacggcataagccgcgccgaacagcgtgtcaggtcttgtcgtaaacaccgtgaacgtgtcatcagtgccgtcgattgcgaaatgcacgtttgcgccttcagaacgtccgatccagttgcgctgcatgtctttaatgctttcaggccagtccagatcttctaaatcttcaagaagcctgtccgcataagcggtgattttcagcatccattgtttcatcgggcggcgttcaaccggatgtccgccccgctcgcttttgccgtcaatgacttcttcgtttgcaagcaccgttccgagtgccgggcaccagttgacaggcacttcgtctacataagcgagacctttttcgtacagcttggtgaaaatccactgcgtccacttgtagtagtccggatcagtcgtattgatttcacgatcccaatcataagaaaagccgagcgattggatctggcggcggaaattatctatattgtgtttcgtgaactcagccggatcattccctgtgtcaagcgcgtattgctcggcaggaagcccgaacgcgtcccatcccatcggatgaagcacattgtacccctgcatgcgtctcatacgtgaaagaatatcggttgccgtatagccttccggatgcccgacatgaaggccggctcctgaaggatacgggaacatgtcaagcgcgtaaaacttcggcttgtcattctcttcactggcggcgaatgttttatgctccaaccagtaattctgccatttcttttctattttttcgtgctgaaaactcaacgcaaaaacctccttctgattgaatacggcgtatgtagtccaagtattgacgggatgagaaagattatattcagattattctaaaactaaaaaaactccctcatcccaaaaagggacgagagatttttgtttcccgcggtaccaccctcgttagcgcggtttttagccgcactcacttgatacttttaacgcagttatgcgtcagcggttttgccgctgcaactctgaggcgagttcggaaacagacttgattgacttgcaccggccgtcaactctctgactgcaaaatctgcttcttactgctcctcttcactgttcttatcgctaccgtaatcttacctgtattttatagaattctgttcataagtgcaagcaggtttgtatacaatgggaatgtacccagaacgggtcatgagcggggatattattttgatggaggatttttttgctggtgtggttttgcttcggccgaatcactgttttgttccctgacaaaatcaaagcttctgagaacagcttctccgccgtagcctgcgattatggataagatgacgagttgaattcctgaatcggggtcagcggataagacaagtaagatggaagcagccattccgataaaaccatcttccaaaaaaccgagatagataaaccgctttgtcattctgggtttctccagcctgcctctctttttcacatgaccgagaacccccatgattcctccaattacacaagcaataattacctgatgcagcatcttcatcaccttcctaaagcccttatttagtaaagcgacttcaggccatccagcccccttacgaatacgatgattttcgatatctacataccggcgaatgagcaggaaagtaaaaagcttgtttcttccattatatgtgaacacatgatcggtaagcttgatgcattagattcatttttcacccagtgacaatgacctagtcacttacttagcggcgatataccttctccttatatcttcagtgtatatgaggacaagcccgaatgacaaatcgcaaacttcggctgcttgaatcagaacatatgttatgctacggttactgtagattcatttaaaaaggggagaaacaacggctgaaaaaagcgcacagctttacggccaaaagggggttttatatggctgactcaaatgtattcggaaaactggagcagctggagcttatcaaaaaggcgcttgatcacgcacgcatcggcgtggtgattacagacccctctcttgaggacaatcccatcatatatacgaatcagggatttatggatatgactggctattcttccgaagagatattaggtaagaactgcagatttctgcaaggcaaagaaaccgaccgaaaacaagtcgcgaaaataagaaaaagcttaaaacataaagaaaagatcacggtgcggctgaaaaatgtaaaaaaagacggcaccccgttttggaatgaactcaatattgatcctctttatgttgaagacaagctctattttgtcggttttcaaaaagacatcacagagcagaaagaatacgaaaaactccttgaggattccctcgcagaaattacgatgctgtcaacgccgattgttccgatcagaaacggcatctccgccttgccgttagtggggaacttaacagaagaacgatttgactcaattgtgacaactttgacggacatattaaccgcatctaaagatgattacttaattatagacttatcaggtttggccgaggtgaacgaacagaccgcggaccggattttcaaattgcaccacctgcttaaattaatcggcacagaattaatcatcaccggtatcaagccatcccttgccatgaaaatgaatcagcttgatgccaatttttcttcatttaagacctatttaaatgttaaggacgcagtcaacgtgcttcctgtcgtataaacaaaaatcccgccgaaacggcgggatttttttgacgtcatcgcacttggacgttttgtttatgaacagctttcaggcgtttgtcgtaaagcaccgtcgctgcgatgctgacgacaagaagcaccatcaggatcaagagcagcacgctcatgccgtactgatcaaccagcacgccgccaaggagcgggccgatcattctgccgcccgtcgcagcgctgttgacgaacccttggtaaaacccttcttttcccttaggcgcaagctgattggcaatagtgggaacggcaggccagacaagcatttctccgatcgttaaaatcaccatcgcggtgaggtacatcggaaattgcttggcgccgagaagcacgccgaacgagacgataaaaatacaaaagccgatgaccatctgcgtttttaacgcaccggaccattttttcagaacaactcctataagaggctgtccggcgacaattaatattccgtttacggtccagagcacactgtataatgaaagcggcataccgatgctttgagtatgtgacgcaacggttgtggaccattgcgaataggcaatccacccgagaacatacccgccgctcagtataaggagcgccgtaaatttcgttctgctgctgacaggctcgtagtccagaacagagacctggcccgcatttccggttttgatatttcgaaaaccgaaaaatacaataaggaaaaacagcacatacagcaaggcattggctaaaaacacgtacgtaaacgagtacgccgcaaccattcctcccagtgcggaaccgacagcgacacctgcgttctgagctacatatatcgcattaaaagctctccgcccgccttctttccagaccgctcccgccatggcgtagctggccgggaacacgatgccggaaccgaacccgacaatgatgagcagccaaatataaacgggccattggtgaaacagtacaagtccgagaagacttgccaaagtgatcataatgcccaacataatggatttgaatccgccgattttatcaaacaaaaatccgccgcataaattccccgctacactggctccggaattcagcatcagaacaatccccgcaacagtcagcgatttccctaaatgattatgaatatagatcgtattcagcggccacaaaaaagatgcgcccgtcacattgataaacattccgatgattaatatcttcaaagcgcgcggcataccgatccccctttctctataaaaaaatccatgaaaaaacggaaaccgcaagctgcagctccgtatcggtcgttatcatagcacattcattctatccccgcggacgccttttttcaacataagaatctgaaaaaaataatgccggaatgttgaaaaaattacaaatgattggattcacaaaaacagcccgccatcatgctcttttcttcagcagccaaaacgggatatacagaatgaaaaagctcaatatcaccgccgcttccattgaaagaagataccacggccaaggcccgaaaacattcagaagcgaagcggtcttcggttttttcattaaataaaggtagttcgcattcagcacacgatcaataaaaaagacacacgccccgtacagattgacgatcagcactgacacccaaagtgcgtgcaccgacggtctgtacttttctgcactggccataaatagacaggcaagaaaaacacagccgtgagagacgaaaaacacgatataccgaaaatgagggaaggtatacgcccctaaatcaggcgtagccatcgcctgtatggcgctgcccaaaccggcaaaatagaggaaggcgaacagctttttgctttttgtcataaccatcagcatcgccaaatagacggataggtcgctcagctgcagcggcagagatgttttcagcgaccaggcatgatgaaagagcagccatatatggtagcagatctgcgacacggcaagaagaatgaacagcacatatcggaaaacgcgattcggccggccgtgattgagctttttccgtaatatgatcacgaacactcccagcaatccgatgatgaaaagcgtgaaaatgtgttccgcagaaaaaagatgaaaggcccctgtttcagatttcaattgaaaatatttctgcataaggctcccccgcgcgaataaatgacgtatgtctattcttttaaaaatcgctttcttctattcatgcaaaaaaagcctccgctgtgcggaggctcctcaacttattttacaatgcggattgaatgacttttttataataaagcaccgacaatatgccaaatatggaatacagcaacgtatacagcgccatgaccatgatcatcggcgtccacacctcggttccgaataaaaaccatcctgactgaacggcgaaatagctgtggaaaagcccgagaacgagcggaatgccgaaatgatacgcctgcttccggcggatgcctttcagcagatctcccgttgtgaaaccgagcttccgcaatatcgtgtaatcagccttttcatcctcgcactcgcccatttgtttaaaataaaggatacaccctgaggtgatcagaaaggttaagcccaaaaacccgacgataaacatgatcagccccatgtttttcttttgggtgtcagccgtttcaaactgtgaaagcgcgccgtctgaatagcgctgcgcctgaaacaggtcatcagctttttggacgtcctcttcatgtttgagtgtaatgccgaaaaattgatttgattttccctggatggatgggtcgatatctttctcaatccggtcaaatacatgctgcgtgacaataacggtcggcagtcctccgcttgtgaatgtataagacaggatgaagtcgttcttcaagcccttatacgcgagcggtattttatccgttttgccgtttacttcaatggaacccgacgtttttaggtcgagaaattttttcatcatatcattatatccggtaaacacagcttctccgtcagaaagtgccaccccttccgcgtctttctcacttacaatcggcagcgccaagtgggatgggtcttgtttaaaacttttcatatcaccgtttatgatgttcttcatattgacaccggcctgaatggtcttgattgtcttcacttgatacccaattccgttttttttcaataaggcggtaaatgagtcagcctccttttggttatcaaacgcaaagtcagccgccgtattttgctcggctgatttttccgcagagtaatacgaaatatagcttaaagacagtaaaccgattgacagcgccgaaagagtcgtaataatcgtcagcagtacggcgttagacttcatccggaacatgatggatgacaaagacagcacttcactgacattcagatacccgccctttgattttctgataaggttagccagaaagctgaccgaacctttataaaacaaataggttccgataatcacagatccgagaataaacaccattgccgaaaacagttcattcatggtcgtaaaactgcccccgaatagttgagcggacaccgcatagcctgcgatgatggccgcaataccgataacgccgattgtcatctgcagccaagagagccgccttatgccgctttctgacgatgacgcagctttaaataaagacaaaatgctttgccgtttaataaataagtaattcatcatcataatcagcacataaacggccccgaacacaatcaacgtctgaacgagcgccctgcttgagaaaaacaaggagacagcggcttttacaccgactgtatggaacagcatcatcatacataatttcgaaagagaaaagccggcaaaaataccgatccatatcgacccgaaatacaaaataaaattttctgtgctgagtatgcggaaaatgtgcattttcgtcatgccgattaatcggaataagccgatttcccggccgcgccgtttaataaaaatagtgttggcgtataaaagaaataccgacacaatcgccacaagcagaatggaggcggcccggatcgccgccgctccttttatggagcttttcatttcatcaagcgccggatcgtattgcattgtgacaaaggcgaaataaagggcggcgctgaacaccagcgcgaaaacgtaaagataatagtttttcatattctttttcaggttctggaagatcaaatgatgaatgctcatgcctgaaccccgcccaacacgctttgtgttttcataatatcctgaaaaaagtccggtctctcctgaccgcctttattcagctgtgtatacacacggccgtctttaatgaaaaccacacgtccggaatagctggcggcaaccggatcatgcgtcaccatcacaatggtggcgcggcgcttctgattcaaacggctcagtttattcagtaaatccgaggcagccttagaatcgagcgctccggtcggctcatcggcaaaaatgatgcccggctcatggataacagctcttgcggcagacgtccgctgtttttgcccgccggaaatttcactcggatacttatgtcttaaatcatagatgccaagctcctctgccgtctcggcaaatcgcagatccgcctcttttttagacattttcgtaatggataacggcaggagtatgttttctttcacggtcagcgtatccaataagttataatcctgaaagataaagccgagatgccgttttctgaattcggcaagctgtttttccttcatggacgtaatctccgtctcattcactttaatggtacccgcgcttactttatcaatggaagaaagcacattcaaaagggtcgttttccctgatcctgacgggcccataatactgacgaattcccctttgtggatctgaagatcaattcctttcagcacctcttgtttattcagcttatttccatagcttttgcgaatattgcctgcttctaaaatcaccacgttacgattctcctttttacattggttatatttattgtaagaacaggagccgtttttttcgtttgattaagcgaacaaaagagaaaagcatgtgacacttttgtcacacgctgaacgtgctgacggcatcgttctgcttcggaaacaccaatgtaaaaaccgtgcctcgtttcggctctgatcgtacactgatgcggatgagaagcgggaccgcagctttttgagccaaatacaggcccatcccggttgacgcgtgatcacggctcattcgcgttgaagtaaaccccttttcaaaaatgcgcggaagatctttaggcttgatgccgatgccgcggtcttcgatatccacatgcacccggccgttgtgttcatagctttttacggtaatatcatccgcttcactgtatttgacggcattgcttaacagctgtctgatgatgaaggacagccatttcccgtcactgagaacgtcttgtgcctcaagctgaatgtcaaacccgattcctttctgtatacaccatgattgcaggtttttaatttcgttgaaaacgagaggacggagctgaacgtgctgaaatgataaatcattttcaataaaggtcaatcgtttctgatgaagctgctggtcaaggagatggtgaatccgcagccattcatactgcaaaggagctttcagtggctgttcatccaagcgttcgatcataaggttcatcgctgtcagcggtgttttgacttcgtgaatccacgacatcagctcatctttctcatgctctgaggccgcctggagatgaagtgagctttttctcaattgctctgtctgcccttcgatgctttcttcaatgatggattcaaacggactgtctggctttttcagataagaaatgtctaaattggcgtcccattctgttaagcttttataaaaagcggtctctttgcgatagcggaacaagagaaacacaagaaacagaagaagcgatagataaatgaaatacagcaccgataaaaacggaatggatggatcaatatatgccgcaaaaaggagcacggcctgctgaaaaagaaacatcgcgatccagctttttctttcaagcagaaatgatttaatcataaagaccgtcttcttccttcgcgatgtacccctgccccactttggtttcaatcatcttcccgatgcctaattgatcaagttttttccgcagccgattgacattcaccgtcagcgtgttatcactgacgaaacgctcatcattccacaagcttctgatgagttcttcgcggctgacgattttatttttctgctcggccagcagttttaaaatcagcatttcgtttttggtcagctcaactgaaccgttttcatggctcaccatgtttgtttcagcatcaatggcagccccgctccaccttttgatgagcgccggttctgcattgtattgatacacccgccgaaacacggcttgtattttagcaatcaagacgtcaaaatgaaaaggcttctgaatgaaatcatctgctccgagctgcatcgacatgaccatatctgcgggatgatcccgcgaggacaaaaacagaatcggcacgtttgattgggagcgtatcattctgcaccaatgaaagccgtcaaatttcggcagctgcacatcaatcatcaccaaatcgggcttgatttcggtaaattcccgggtaacccggctgaaatcctttatcccgtgcaccgcaaatgaccagcccgttaatctctctttcatctcgtgaaacaaagtgttatcatcttctattaacaaaatatgaaacatttgtatacaccctttttctgtctgatagaggaaaaaccggctgttgtgtccagccggttctttctctttacaattctcttcttaacgcggtcagaacgttggtttttgtcgctttccgggccggattcatacccgagatcaccgcgactcccgcacaaatgacaactgcgattacaacgaggctgagcgggatataggagaaggtataatgaagatcttcagctccggtctttccccctaccgctttcaaaataaccggcacagccagattgacggcaaaactcactccgtaggaaataataatcccgatcacagatcctaaaatcccgatataggcgctttccatcagaaacattctgcggatgatggacgggcttgcgccgatcgctttcataatcccgatttcctgcgttctttctgtaaccgccattgtcatcgtgttgaaaataccgatggcagaaatcaagacggcgataaagccgacaaagatcaggccgattttaaagacgaggaaaaatgtgttgacgccctgcagctcggttgtgacggacatgactttataaccgtcatcactcaaatcattcgttaactgttcaacattgtcaaatttgtcggcgtagacttttatgcttttttcagcatttccgcctttcagatctaagaatttcgaaaagtcctttttgaattgatcactgataaaaatatttgtatcctccatccactcttgggacggtttttttgttattccgactaccttaaagtcgtacgttttggttccttccgtttttccggtatcattgttcgtttttgagatgctcagctggatggttttattcagcagatcctccgtatagcctgttggcttttccacatccgagacattgtcttgatgatcctttaattctttgttgtattcatctgcctcttttttcgtccataggttcttcgcgaaattatagccgaccacaatttcattttctgatttggcgactcttccccgatcaagctccatattggctttgacttcgtctttcatgtttgtcagcactatagctgaatcttcatttgttctgtttcccaatgtcgctttattcggttcatacacttgggttctttcaacgacagacttgacattcttatatttttccaagtctgatttctttacggcttttccgttctcctggccgagcacattgatttccgtcacaatctgctggctcatggtaatgtctgtaatcgttttttgaatcccgaatccgacggaggacaagacaactaaaaacgcgcacgccattgtcgtcgccagcaccgtcatgaaaacacgcagccggtttttcttcatatttcttctgataaagtgaacctgatccttaaatctcaactgtaacgcccccttttaatacaccgtcatgcagctggaattttgaatgagcaatggaagcgacttcatcgtcatgcgtaatgatgacaaatgtaattccgcgctcccggttcagctgctgaattaatgcaagcacctcaagctccgtttctgaatcaaggcttcccgtcggctcatcggctaaaataatcgacggatttaaaatcagcgcccttgcgatactgacacgctgctgctgaccgcctgacagctcattcggataatgattcgcatgattttcaagaccgacccgtttcagcatatccgcgactttctgcttgcgttcagaaggttttacgcctttgagggcaagcggcatttcaacattttcataggttgtcagactcggaatgagctgaaaactttgaaaaatgaaaccgaaatgcccaaggcggaactgcgcccactctttttcactgaagcctgtcacatcagtgccgttaatgacgatacggcccttcgtcggtgctatatagccggaaattaaattcagaagcgttgattttccggaaccgctccgcccgacgatacaggcgatttcccctttttcaacggtcaaagagacatccttcagcaccggaaccgcactctctctgcctttcctgccgattttaaatgaatgatcgatatgctgtacatctatcacgtaaaccactcccctttatatttgtttcgtttttttatacatgaagtaataactgatgaaaaacccgataaccgcaccgataagcatgccgaatatgtagccggaatatgaaccgttataagcatatccgcatacacccgcacctcccaacatactgatcaccatgacgagcacttggaagatgcgttctgtatgtttgctcaagataaaatgtccgcttcgttcactcggcattttcaggaaattcacatagccgaaaagatagaaacaaaaacccattaatgcacatataagcaatgcatgtttcatgtaatgaatccatgacgtatggatataagcggccggcatgaaatagatcagaaacccgctccaagggaaatcaatatcccgcacagcctgcttgccaaaaaggaactcagcgtttaatagataaatggtgaaaatcacgattggaaagaaggagatcgtgaacgctgtgatgagctgtgctgctaaattgccagttattgtgccggcagctgtcactaatgcataaatcatcaagctgacgaccagcatccctgcgctgaatgagtgaaaatgatgtacagcgtcaggtttaagcataagaaacaatatgtcagacactccgtaagagacaagctgggaaccggctaacacggctgctcccagtaaaaacttagtatggaatatccggcttctcgaatacggaagacttaatgtatacattttttcagcccgtcctgctcttgtcagaaaaagccccataataaccggaggaatgaaatgcagcccaattacattccgatggctgtaatcaatgctgaatgtacaaactgaacccggatattgatgaagtacactcaaacaatctttataatgaaaatactcatttataattgccaaagggcctatgataagtaagaaccccgcggaaaggagcagcagcgtctgccgctgtttccattctttataaagcaaaccgttaatcggcaccttgccttcccccaaactaaacatgttcatacagacctacatatgctttgttttcctgtaaaccgtaaaataactgatgaaaaatccgataacggcgccgataataatgccggctaaatatccgaacatcgtgtccgtgaccccatatccgaaaactccaaaacccataaccgcaaacgcgattaccaatagctgcaccgggcgttccaattttctccaaagaaagaatctgccgttccgttcattcggatgtttcagaaagctgacgtaaccgatcagataaaagacgacgctcatgactgccggaatgagtaagatcagatgtctctctctgatccagtcgttaaacacatatccaataggtgttacaaatataaaaagacgagattcgatatagctgctgatgaaagagaattcattaccaatactaaaatcgaaaacaacctccaaattcgcggccggcagaccgatgagtaaaaagggcagaatcgttacggtaaacgccgttaacagctgagcgaatatatggcccgtcaatgctccggatgccattaacagtgcgtaagccataaaactgatgacaatcattccgattgaaaaatgatcaaaatcgtacgtatggctcggtttcagcagagaaatcagcaatgacgccgctccgtagcctatcgcctggggaacaacaatgactgccccgccaagccagaatttggtctgaaagatttggcttctgctgtaaggcatgcttaacagggcatccatcgttccctttgtccgctccaagcctaataagaagacagcaatgatgacactcacaacccagttgaaggaaagaagcgacccattcgtataactgacgacgaactcacaatcttgcggagccggatcattcaaacatccctgatatgttacgtaattgttataaaccataaaaggatttgccgctattaaaaaaatactgctcaataaaaacaaccactgatttttcttccattctgtatacaatagcccccgcggtatcattccggtcctcctttcttacacatgcttcgtttttttataaatcgcaaaataactgaccaaaaatccgaccgctcctccgaccagcatcccggccgcataccctgtcatcgtctgtcccgtcgagtaccccgccaggccaaaaccgagaacggcgataatgattaccacaatctgaatgggccggtcaagctgtctccagaggaaaaaacggccgttccgttccacgggctgtctgacatagcaaaagtacccgatggcataaaatataatgctcatcactgccgggatgattaatatatacttgctggcagatacccaattcgtatcaatgtacgtaatcggattcagatattgaaaagaattgtttaggtaagcattgactggcggcatcagctcatgcatgtcgatcccgaagatgacttccgcatttgtcaacggcaacgtaataatcaggtaaggcgctatcgatacagcaaacgccgttaacagctgggcgaacgtattgcccgttaagcagcctgcgctcgcgaccaatgtaaaagccaaaacactcacaatgatctctccaacgctgtaatggtggaagaaatatacgcgttcaggctttaacagaagaatcaacagctcagccagcccgtagccgatgacctgaaagccggcaatgaccgccgctccgagccaatatttagtgtgaaacacctgagcgcgggaataaggcagactgaaaagcgtatcaatcgttccctttgtgcgctccagtccgaataagcaaaccgccaaaatcacagcgggcgcccagttcaagttcagcattctgctctccaaagaattcacataaaacttacaatatgctcccggggtatccagacagccttggtagaccagataggtatttaacacttcaaaaggattgaccgccgctaaaaaaaggccgaccataacgagaacagttcgattctgcatccattccctgtatagcaatccccggtctaccatctccggttccccccaaacttcgcgatgaagacttcttctaagtttacaggaagctcgttccacactttcgggcgcagctcttgcagaaatttctttttcttctcatcgttcttcggaatcagcactgtataaaacacaccggcatggtcgaggatcggtatgttttgttctctgatcatcaagttgacatcctcatcaaacgccatttggattttcatgtaatcctctttcatatcatccaaatccatcacattcgtcagctgatttccttccaaaaatccgatccggttgcacatgcgctcaatatcttctaaacgatgtgaagtaatcagaatgctcgtttcccgttcagccacttcatccaccataagctgaagcacgtcatgacgcgttacagcgtcaatcccatccgtcggttcatccaaaagaatcaatgccggacgtgaagcaaaggcaaggacgagggccagctgttttttcagccctgtggataattcccggtatttcttcgtttccggaatgctgtacctgttcatgagctcattggcgtaagtcacatcaaaattcggatagattctgcttacaatagcaacaagctgtttatatgtatatttgtcataaaaaggattttcaacaggcatataaatgatattctgttttactttcggatgccgctttatttccacctgattaaataaaaccgtcccttgatccggcagcagaatctgctgaatgagccggagcaatgttgttttccctgatccgtttcggccgagcagcccaaaaatttctccttttccgatggtgagcgaaatatccttgagcacttctttaccgtcaatcgtttttgagagattgcgcaattcaatcatgatccctgcctcctttcacatcagcgctgatttcctttatccattcctgcagcttctccagctcaactcccgcgtaatgggcatcgatgatgagctgtttcaattgctcttttatcatcgtcatcttcccttcaaccaatgtcttttttgcattctccgatatatacgttcctcttcccctcagcgtttcaatgacaccatcgcgttcaagctccttgtacgctttgctgactgtattcggattggcgataatgatcgttgccaattccctgacagaaggaagtttatcccccggcttcatgatcccttttaaacaaagctctttcaattgctgtatgatctgctcataaatcggggttgagcttctcggatcgatttgaatcatttacttcccttctttcttttacgagctgctctatttctttaaatgttctgccactgaaaaccgatgacgcaagaatgacaaacagactgctggccaaaaccgaggcggcgataataagaggcacatcttgttttacggatcttttgtttttcatgaaggctctcctttcctatgctcaacatttatatttcgatttcattttttgagtgtttgcagtgtattacatcaagtagtacacgtaatacaataaacacactccgccctattgtcaattcttttttaaaaagaactacaaaaaaacccgccgggattccggcaggttttgcaccatctaaaacggtgcggtcagtaatcgaaattacgctgcaaaatcatattgttttgcagggtctggagctgcaatctcattcggtaaagctgctctctttgctgatcattcgcagataatgacagcttgtttaattcattcaccgcgttttcaagcatcatttgcgcttcactgtactcattatcattataatgctcttgtttggaagcggttttaaattgctcattcgcaaattcatacgcctgttcgcttctttggagatgttcatctactgattgtcttgttgccaacgaaacccctcctcagtgaatgggaaatcaaacttagtttgagcggaggaaaaatgattaacacccgaagattgcaggaaagagaaccaaattttccgtgagtcaggaaaaggaatgagaatcctgcccgcagttatactaaacaaaagaaagccgcatctgttttcacattgtgaacccccatcattcatgctacaattttaggatgcatctgatgtgagggaggctttttgaacattgaacgagaataacccttttccttattcaaatacggaaaaacggtaccatacattaaattatcatctgcgggagcatttcgggcataaagtgtttaaagtcgcgcttgacggcggttttgactgcccgaatcgggacggcacggttgcacacggcggatgcacattctgcagtgcggccggatctggcgattttgccggcaaccgggccgatgacttaatcacgcaatttcacgatatcaaaaaccgcatgcacgaaaagtggaaagacggcaaatatatcgcatatttccaagcgttcacgaatacacatgcgccggtggaggagctgcgtgagaaatttgaatccgtactcaagcttgacggtgttgtcggcatgtctatcgcgacccgtccggactgcctgccggatgatgtcgtggagtatttggccgagctgaatgaacggacatatttgtgggttgagctcgggctgcagaccgtacatgagcggaccgcccttctgatcaaccgcgcccatgattttgactgctatgttgagggcgtcaataaactgagaaaacacggcatccgtgtttgttcccatatcattaacgggcttccgctcgaaaacagggacatgatgatggagacggccaaagccgtcgctgatttggatgttcaaggcattaagattcacctgcttcacttattaaaaggcacaccgatggtgaagcaatatgaaaaaggaaagcttgaattcctttcgcaggaagaatatgtccagcttgtatgtgatcagctcgaaatcattcccccggaaatgatcgttcaccgcattacgggggacgggccgatcgaattaatggtcgggccgatgtggagcgtcaataagtgggaagtactgggcgccattcaaaaagagctggaaacacggggaagctatcaaggaaagctcttcagaaaaatcggggaggagactgccctatgaccttgatgcacatcctccctttcagtaaagaattgctgaagtccgccgcacaagaaggagatatcacggttgacgcgacaatgggcaacgggcatgatacatattttctggccggccttgtcggtgagacaggacatgtccatgcctttgatattcaggctgatgcactcgccaaaacgaaggagcgtctcggtgacgccctcagcccgcgcgtcacgctgcaccataagagccatgatcaaataaaggcatccctgcctgaggatgcgcacggccgtgtggcttgtgccgtgtttaatctcggctatctgcccggcggcgataaaagcattacgacaaacgggcactctaccatttctgcaatcgaacagctccttgaactgctgaaagagaacgggctgatcgttctcgtggtctaccacgggcatcctgagggaaagacggaaaagaatgcgcttctggaatattgcgaaaaccttgatcaggaaaaggcgcgcgtgctgagctacggctttctcaaccagcgaaacgacccgccgtttattatagcaattgaaaagaaatctcctggtaaataaagaatcggcctgtcatcaacaggccgattctttttgtgaacgtatttactttttcaaaaaagtcaattaccatgaaataatgggaaaaagttcatttttccactgaaacacctgagaggagcagcagtttgaatattcttcgcatcattttttcaagtgttccctacgtgatgttcatcatcattttatcaagacatttaggatttgagttcgcgaaaacctattactggtggtttgctgcatttttcgtcatcgggctggtcggcaaatttgtaatgcactttgcggaaaaaaagaaaccattaaaaaaagagacagcgtaaattgcgcatgtctctttttaatgggcactgttcatccattacgagcttttcgtccaagccatcttctgaaatttgcggtaggctcttccgttgatataaaagaaaaatgacgtttttccgcttgccctgatcagctttcgcgcgaggcggcccatttctttttggctggcgactttgtcatcggataaatagacgccgagcagcccccggttaatcagccggtgaaaattttcatgcggaatgccgtgcaaatgttcatccgctttttcaataaaatgcttcagtctctgcatcatttcttcatgagattgataatacgtacagaaattcagatcgccttcaagcagatcctcttcctggtctattaaataatcgagcagaatgtgcagcccttgtatgtacggaaaataactgctgcggattttctcagcggtatgttcgttgaaatcaggctggaaagagtaagcgacgagacagaaaatgcctaacgtcgatcctgcgcaagcagagaattcaaaccactccatttccggaagctgtgaccggtactgctcaaaccagcttttaagcctcggaacgcgttcatgctcaacgacatgcttatgcacctgaagatcgcaataataatcgcacagctcgagcaaataaggtttaatgatgccgtaatgttctattgacccgagcacccgctggcatgttctgaccagctcatgaagataaccgccgtcatcctgctcctctctgtactgatagtacggctgcacctcggcaccgactgtcagcgcgtcacgcatcgaaaggtgaagcatgcggaaatcttccggatcaagcgatgtgctgcggtcacacagattgtccagataatcactgatcgtctggtacgcaatgataaattgcacgcatttctgtttttgctctcccgacagcagggctaaaatgccgccgccctcacaatgaaacgatttatcacggatacttgcggccgcctgctcccgcagctcggtatttttaatggaatctgatttttcccgccatatattcaattcctgatgtacgagcggaaaaatttcacgatacacttttgccataaggttaaaaggatgttccggtactgtcaacaaatgcacccccagcgaattcaaatatactgatctgtaaaggctttcgccgccttaaacacagcttctctttccggttcattaaaaatttcatgataaagcccttcccattcccggtatgatttattatgggaagccacaccggaaaaccatttacggaccttcattttatcaacgattttgtcatcaccgccctgcataagcaaaagcggcacttttaaaaacgcatcagtcggcaccatagcggcatcaatggtttttaaaagctctctgtaccatcttacagatactttcgtgacatataaagaatcgttttgatccgcttcaatcatatccgcattccttgtcgccatatcaggcgataaaccggagtccactctgagggacggggcgagaacattcagtcctttagacgcaaaatcaagcactttattgacttttatttgcagcccaagacaaggtgatgataaaatgagtgccgtaatgcggggatttctctgctgcttaaaccattctatcgcaatcagtccgcccatgctgtggcccaaaaggaaaacgggcgattcaagcgttctcgcttgatcaatccatatatctacttcatcaatgtattcttggaaagagcgaatatgccctctggcgcgggtggatgttccctgaccgggcaaatcacccatcaccacgttatatccggaagatctccacatttcaacgagccatttataacgcccgtggtattcgcttgccccgtggattatgacaatggtaccgacgggcctgtctgctttccaagtccacatgctgttcacctcttacataaatttagagaaagaaggatgagacatgataatctacccttataaagaatttacgccggacatacatcctgaagcgtttattgcggataacgccgtcattacgggcgacgtcgtgatcggagaacaatcaagcatttggttctcagccgtcatccgcggggatgttgcgccgacaagaatcggaaaaagagtcagcatacaagacttgagctgtctgcatcaaagtccgggccgcccgcttcttattgaagatgacgtcacgatcggccatcaggttacactgcacagcgcaatcatcagaaagaatgctttaatcggtatgggctccgtcattctggacggggcagaaatcggagaaggcgcgtttatcggcgccggaagtctcgttcctcccggcaaatccattccgcccggctttcttgcgttcggccgccctgcaaaggtcatccgccggctgacagaagaagatgtacgggacatggaaagaatcagaacggaatatgttgaaaaaggccgatactataaagcactgcaagagaaataaaaaagatcagctttgttttactactgtaccatttttcaaaatattatttaagcaaaaaccatttgcgttctgctggttgtcagaaaacagaagcaaaatgttcaggaatttgttttattcttccccctttgacccgatcctatgaaaaaagagcccatttcagcgggctcttttttttacgctttttcggcaaatgtctgtccgttttccagatttatgtgttttcttttatggaagcctttcccgtaataggctgctaataatatgcagaaccaggcagggccgatgatgacggccactcgggtctctgcattaaaagccatcagtacaacgacaaaagcgagaaatgccagtgagatataagaggaaaagggatataaaggcattttatatttcagtttttttcgttcttccggctgtaagcttttacgatatttcatttgagaaagcaaaataatcgcccacgtccaaatcgctccgaacgtcgcaatgcttgtcacccatgtaaacactttcgccggcaccacgtagttcaacagaacgccgatgcataacgcacccgctgaaaccaataccgcttttcccggcaccccgccttttgtgaccgtgccgtaggttttaggggcttcattttgctcggccagattaaacagcatgcgtcctgtgctgaagatcccgctgttgcaggacgaaagagccgccgtcaaaacgacaaaattaatgattccggccgctgcggggattccgattttttcaaatgtcaaaacaaacgggcttccgcctgaaccgatctcctgccacggataaattgacataatgacaaacaaagctccgacgtaaaaaatgagaatgcgccaaaaaacagtatcaatggcgcgtgccagtgatttttccgggtttttgacctcaccggctgtgacaccaatcagctcaatcccgagatatgcaaacatgaccatctgcagcgacagcagcacccctttaatcccattcgggaaaaagccgccgtggctccataaattgctgatcccgagcgcaacgcctccgtttccgagaccgaatacgatcatcacaaggccgatcgcaatcattgacagaatcgccaggactttaatgagcgcaaaccagaattcaagctcaccgtatgctttgaccgccagaaagttgacagccgtcataatgacgagtgcacaaagcgcccagatccatgacggcacgtcagggaaccagtagcccatataaatgccgaccgcggtgatttccgccatgcaggtaacgacccataaaaaccaataattccagcccgttaaaaatcccgccagcgggccgagataatctctggcataccggctgaatgagccggccacaggcttttgaatcgccatttcccctaatgcccgcataataaaaaacataatcagcccgctgcaggcgtaagctgctaaaatccccggtccggcaagctttatggccgaagctgacccgagaaacagcccgactcctatcgcggctcccaaagacataagcgagatatgccgctcttccaagccgcggtgaagcgtttttcctttgttttgcataactctccctccccctgattttgacagaaaaaacaaaccgagacgaaatagccagaaaacactctccggaatctgtccgatagtcctataataacatttttctgaatattgcgtaacactttgcggaaaacatagcggaatagaaggtttataaaaaacaatagaaaaaaggctttcgataacatcgaaagccttttggattaaacgaagatgacttctttcggctgatgattcagctcttccggcaccagtcttttttcgacattgatgctgtgccagatcatgaagatcagcacggtccagattttgcggctgttatccgctctgtcggcacaatgatcttcaagaagctgaaggacataatccttttcaatataagcgtctgtttcgctttcatggatgatgttgcgcacccattcgttcatttcatttttcagccagtggcggatcggcacagggaaaccgagttttttacggttaagcacatgatcaggcactaccccttcagcggctttacgcaggaggtatttcgtcgtgccgtttttcgttttcaattcatccggaattttagaggccacgtcaaacacgactttatcaaggaacggcacgcgcagttccaatgagttggccatcgtcattttgtcagcctttaacagaatgtcgccgcgcatccacgtatgaatgtcgacatactgcattttattaatgtcactgtatgaacggctttccgtaaagtacggcttcgtgacatcacggtatgaaagctctgaattgtaatgtttaagcagctgttttttcacaggctcttcaaaaatcttcgcatttccgatatagcgctcctcaagcggtgtgcagccgcggactaagaggcttttccctctcattccttctggcatgaccgacgccacgtgaagaagcatttttttcagtccggacggaatgcgttcaaacggtttaagcgacagcggttcacggtaaatattgtacccgccgaacagctcgtccgcgccttccccggataacgcaaccgttacatgttttttcgcttctttcgcgacaaagtacaaaggaatcgccgccggatctgcaagcgggtcatcaaagtgccagacgattttcggaagctcgttcatatactcctctggagaaatgactttgctgatattttcaatcccgagcgcggcagctgtttccttcgctacatcaacttcactgaagccctgctgctcgaagccgacagaaaatgttttcaggttcgggtgaaattctttcgcaactgagacgataaaagaagagtcaataccgcctgataggaacgagccgacgggaacgtcacttctcatgtggactttgacagagtcaaagattgcgtctctgacttctttcaccaatttatcttcatcagactgaacgggcttaaagttcgctttgaagtacgttttaaacgcgatatcgccttccgggcggatcgtaaactggctgcccggctcgacttttttcacttcagcgtcaagcgtgctcggttcaggaacgaattggaaagacatatattgctgtaaagaagctgtatcaagatcaataccgttttgagcggccattaaactttttctttcagaagcaaaatacactttgtccccgatggttgtgtaatacagcggtttaattccgaacgggtctctcgcgccgtacatgacacggtcagctttgttccagattaaaaacgcaaacattccgcgaagctttgaagcagcttcttctttataatggcggtatgtcgcaaggagcacctcggtatcggaatctgtattgaacttgtagcctttcgcttcaagctcttctctcaattcaatgtagttatagatttcgccgttaaaaatgatccaatatttttcgtcttcatatgataaaggctgtccgccgttttctacgtcaataatactgagccgtctgaagccgaaaccgacgtgctcgtcatgataatacccatcgctgtcaggaccgcggtgaacgatcatttgattcatttgtttgattagctcttcttgatctgcggtttgagttaatggatgcttattaaaaacaccgacaaatccacacatagtatagcctccataagtgtaattttctaattggaccccctttttatagacgctttgttacgccattggtttcacgctatgtaaaaaatcagcatggcagcatctgcaaaaagggaaagccgcttaagtaagcggctataaaattattctcctagtgcttctttgcgaagcgcatccgccttgtcagtacgctcccaaggaagatccacatcatggcgtccgaagtggccgtaagcagcagtctgcttatagatcgggcggcgcaaatcaagcattttaataatgccggcaggtctcaggtcgaagttattccgtacgacttcgatcagtttctcttcagaagcttttcctgtatcaaacgtattgatggaaatagaaacaggctgtgccacgccgattgcgtatgcaagctgcacttcacaagaatcagcaaggcctgctgccacgatgtttttcgctacgtatctcgcagcgtatgccgctgaacggtctaccttcgtcgcatccttaccggagaacgcgccgccgccgtggcgtgcatatccgccgtatgtgtcaacgatgattttacggcctgtaagccccgcatcaccttgcggaccgccgattacgaaacgtcccgtagggttgatgaagtattttgtctcttcatcgatcagttcctcaggcacgacagggttaatgacatgctctttcagattgcgctgaatctgctcaagcgtaatttccggatggtgctgagttgagatgacgatcgcatcgatgcggacaggtttgttgttttcatcatattcaacggtaacttgcgtttttccgtcagggcgaaggtacggaagaatgtcttctttgcggacttcgctcagacggcgggctaatttatgcgccagtgagatcggaagcggcataagctctttcgtttcgttacacgcataaccgaacatcagaccttggtcccccgctccgatcgcttcgatttcagcgtcgctcattgtgccttcacgcgcttcaagagcctgatcgacacccatcgcgatatccgcagactgttcatcaattgatgttaaaacagcgcaagtctccgcatcaaatccgtatttagcccgtgtgtagccgatttctttaatcgtttcacggactgttttcggaatgtcaacgtatgttgatgttgtaatctctccgcttaccagcacaagacctgttgttacagacgtttcgcaggctacgcgcgcgttcgggtcattttttaaaatctcatctaagatactgtcagaaatttggtcacagattttatccggatgaccctcggtaacagattcagatgtaaatagtcgacggtttttactcatttacttttcctcctgaaaaaagatcttttgcaagaccttttcatatgatacggaactcgctccctcttaatacaatgtcatactatatcagagaatgttaattggcatattttatgaaataaaaaaaccttttccactcgaggaaagggtttggtctgtgtgcctttcactcttatcgctcaaggaaatattaaaccttgcatcaggttagcaccttggtttcccacagtgttttcacctgcttttttacagagaaaccggttgctgggcttcatcgggcctgtccctccgccagctcgggataagagtatccgctcaatgaaatatcttatcgtaaaagggcggaaagtgtcaatatgaattaaagcgattacgcgcctttatttcgggaagcaatggaaaaaacacaaacaaaaaataataaatagtatagactatttttatatatatgttatactaattccacattcagcgaaatacaaataaaccggcaaaggaaggtttttatgaaattagttgatttaaccgcagatcttcaagcgttactcgcaagtccgaatgtgcatcataatttatcagctccaaaacttactgaaaaagtgatcagccgaaatgaaggaacgctgacatcaacaggcgccgtacgcgccactaccggcgcatatacgggccgatcacctaaagataaatttatcgttcgtgaaaaaagcacagaaaatcaaattgattggggcgcggtgaaccagcccatttctgaagaagcgtttgaaaagctgtacgccaaagtcgtcagctacttaaaacagagagatgaactgtttgtttttgaaggattcgcaggcgcagatgaaaaatacagactgccgattacagtcgtaaatgaatttgcgtggcataatttattcgcgcgccagctgtttatcagaccggagacgaatgaaaaagatccgcaagcacagccgtttaccattctttcagctccgcattttaaagctgatccggaaacggacggcacgcattctgaaacatttattattgtatccttcgaaaagcgcgtcattttaatcggcggcaccgagtacgccggagaaatgaaaaaatcaatattctcgattatgaactttctgctcccgcagcaggatattctgccgatgcactgctcagccaacgtcggtgaaaaaggcgatgtcgccctgtttttcggtctttccggcactgggaaaacgacgctttcagccgatgcggaccggaaactgatcggcgatgacgagcacggctggtctgattccggcgtttttaacattgaaggcggatgttacgctaaatgtatcaatctgagcgaagaaaaagaaccgcagatttttcacgcgatccgcttcgggtctgttcttgagaatgttgtgcttgatgagaaaacgggtgaggcggattacgacaattccttctacacggaaaacacaagagccgcatatccgattgagatgatcggcaatatcgtgcagcctagcattgccggccacccgcaggcgatcgtctttttaacggcggatgcattcggtgtgctccctccgatcagcaaactgacgaaggagcaggcgatgtatcatttcttaagcgggtacaccagcaaacttgccggaaccgaacgcggtgtgacatctccgcaaacgactttttccacgtgcttcggttcaccgttcctgccgcttccggctcacgtatatgccgaaatgctcgggaagaaaatcgacgaacacggcgttcaagtctttctggtcaacacaggctggaccggcggagggtacggagtcggagagcggatgaaactttcgtatacaagagcgatggtcaaagccgcaattgacggcacgcttgatcagacagacatgacagcagacagcattttcggtctgcacagccccgttcatgttccgggcgttccggatgaggttcttcagcctgaaaacacatggagcgataaaaaagcatacaacgaaaaagcgctgtttttagccaatgagttcaaagaaaactttaaaaagttttcccatgcagactccattgccaaagccggcggacctctcgtttaaccaaaaaagccaagggcgtatatgccctcggcttttgttttttcaatttgtcgaatgaagcgaagtgagtctgtatgtaatgcttgtccggccgttcgcccactcgagcttttggacttcacccgtgccggatttctcgccgttttttgttttgcgcacgtccatcggaatatcgagaggatagacccgatagccctctttctctaataaaaagatattttcctctatccgtttttcattgcctttagtcacaatcatagtattaaattctacaggcattcccaaaatgaaaatcccctttcattctctttttctatattatcatatcataaatccggcatcttaccttgtcttcatccattccgccagacgccggacaatgcgtctgttttcctgcgggggaaaataatgcgtaaaaccgctgtaataccaggtctccaccggtttccccgtctctttcagcttgtcctcaatcatcctggcgtgctcgatcgagacattttcatcattctcgccatggatgagcagcacaggcgcctgaatgcggtctgctttttcaaacggcgaacgccatctgtattcatccggcacctttttcggcgtgccgccgatcacccgcttcatcatccgccgcaaatccttccgctcttcataagtgagcgccatgtcactcacaccgccccaggaaacgagcgaagccgcttgatgccccatctcgatcgcagtcaaaagacccatgattccgccccgggaaaatccgaaaatatgaatccgcccttccctgacgttcggatgctcctgaagcagacggaaagccgaaaacgcgtcctctctgtcctctcccgcaaaatcttcattcccctcgccgccctgattgcctctgtaataaggcgcaaacacgacaaagccttgggaagcgaattgaacgattcttcccggacgaaccatgccgacatttttaataccgccgcgcaaatataaaaaaccgtcgtatgttcccggcgccgcaggctcggcaaggagcccctttaccttcagcccttctgactcatagcacaccgtaaagaggcggacatgcggactcggagacggaaaccttttcttttcaacaagcaaaacaaatgagcctccttccatcatcagttttttattctttcccaacctgaatatgggcactcacacattttttatacccatcatacgatatgtaaagcaaaaaaggttaatttaacgcttaaaacaaggaggttacaccgtgaacaaatggctcaaaacgagctgcgtctttgtcatatgctcctttttcctgctcattcttccggcctgccgacaggaagaaagtctgacgaaggtaaaggtggcggaagtcacacactccatcttctatacccctatgtatgtcgctgaagcgaaaggtttctttaaaaaagaagggcttcacgtttcacttcaaaccacatggggcggagacaaaacgatgacatcgcttttgtcaaacggctctgatatcgcgctggtcggttctgaaacgtccatttacgtggaagcgcaaggagcaaaagatcctatcatcaacttcgcgcagctgacacagacagacggtacatttctcgtggcgcgaaaggatgtgacatcattcaagtgggacgatttaaaaggaaaaacatttctcggccagcgtaaaggcggcatgccccaaatggccggtgagtacgtcctgaagaagcatcacatacagccgaaaaaagacattaacctgattcagaacattgatttcgccaatatttccaacgcattcgcatccggaaccggtgattatgtccagctgtttgaaccgacggcatcccaatttgaaaaagaaggcatcggccatatcgtcgcatccttcggagaagcttccggccaagtgccttacacaacctttatggcaaaagaaagctatttaaaaaacaatgaaaaaacggcggaaaaattcacccgcgccatctaccgcgcccagcaatgggtggaaagccatccggccaaagacatcgcaaaaacgattcaaaaggaatttgccgataccgaccctgccattattgaagcatcgatagaccgttataaaaaacaaaaatcattctcttctgaccccgttctgcaagaagatgaatgggaacagcttcaatctattatggatgaagccggggagctcccgaaacatattccgtacagcaaactcgtcaacacaaaaatcgccaaaaaagtcacctcagaacaataggaggaacatgaatgtcttttttacatgtggatcatgtgacacatacttatttctcgctgaaagaaaaaacaaccgccgtgaaagatatacatcttcatattgaaaaaggggatttcatctcctttctcggaccgagcggatgcggtaaaacaacactcctatccattcttgccggccttattgcccctgcacaaggccgggtgctgattgaaggcagcgtgccgaaccataaagaacaccaaatcggctatatgcttcagcaggattatttatttccttggaaatcaattgaggaaaacgtgctgctcggtttacacatttccaaaacattaacagaagaaaagaaagctgaagttctcggccttctgcctaagctcggattaatcggcgtcgaaaaaaaatatccgaaagagctgtcagggggaatgcggcagcgggcggcacttgccagaacgcttgccccggacccgggcctgctgcttcttgatgagccgttttcggcgctggactttcaaacgaagctttctttagaaaaccttgtcttcagaacattaaaggattttcaaaaaacagccgtgctcgtcacccacgatatcggtgaagccatcgcgatgagcgatacgatctatttattttcgaatcagccgggaacgatccaccaaattttcaccgtgcctaaggagctcgccgccttagatccgtttgacgcgcgtcaggacccggcctttcagccgctgtttcaaaccatatggaaggagctgaattcccttgaaaaacagcagcggcacgattgaagagcttcatcagcagtttaagaaaaaacaccaaaaagaaaaacgccggattcgtgcgtatcaggccgccatttttatcgtattttttgcagggtgggaaatatcgagcaaagcgggctggatcgatccgttaattttcagctccccctctgccgtttgcaggctcttagttgaaaagattgcggacggatccctcgcggcgcacatcggtgtcacattaggcgaaaccgttctcggctttttgctcggcacccttctcggcacatgtctcgccgctctgttatggtggtcaaacaggctcgcccggattttagacccgtacctcgtcattttaaacgcgatgccgaaggtcgcactcggaccgattctcatcgtcgcactcggaccgaattttacaagtatcgtagccatgggagcagtcatcagtgtcattatcacgacaatcgtcgtctttacggcttttcaggaagtggatgaaaattatattaaggtcatgaaaacatttggagcgaaaaggcgcatcatgtttaaagaagtcattctgccggcgtgtgcccccgccattgtttctgcgcttaaagtgaatgtcggtttatcctgggtcggtgtcattgtcggcgagtttctcgtttccgaaaaaggtttaggctacatgatcatatacggatttcaagtcttcaatttcacccttgtatttttaagccttctgatcatcgcgatttttgcgacattaatgtatcagggagtggaactgttagagagaaaatggacgaaaggaaaaatataaaaaagacccgtgcggaaacgccgggtcttcgtttctatgattgaaatacgccatcttctttcagctttttcaggcttatcggaagcaccgaatctttcataatgaaactgaactttttatttcgcgggagattctccggcagttcgctgaacagcaccggcccctttgtttcaaaataatcagcctgtttttcaagcttttcaatatcggcaaaataaatattcttaacgattaccttttccctgccgagcactttatactgtccgacgtactgaaggtgtcttaccgcggcgccggtctcttcttttacctcgcgcagggccgcttcctccgcacattccatcggctccacttttccgcccggaaattcaaacccccggtcttcgtgctcagtcaaaagccacttgtcaccatatcggcatatgacccatacgtgcttcgggctgtctgaaaaaggctggtgttcaaaggagagctgaacagtgttctgataatagtctttaaactcgtacatgtttatccctctaatccgttccttcgtatcttccatacatcataccacagttgcgtttgttcggaagccctttatcaaaaattcagaggaaaaccatcatacccgctagtatagcctcctatgaagcaaatgttacggtttgcgcttgaatttatttttcagggtgtccaaaaggtcgacgagcacctgcggaaccgggatgcccagcgagcttgccgtaatcacaatctgtatcgattcgtataaaatataaaacatgatagccaaattgcggatggagccttcggtatgaagcagctgatcaaaaaaatggcaaactgagactaatgacaaggtcacgatttttttgaccagccgcgcaaaaagcttttttgggctcagctgttgcaaaagagattcctttaagcttgtactgataaattcgatcgccatgaccgatagcaaaatcagaaacgaatactgaaaaccgccgaagaaaaatcccgctgccgacacgatcactgcaaaaaacgaaaagatgccaaagtctctgcccacttgatccaacatcctttcacagaaacggccttacattattctatgaaaggtgaatagaacggactggatttttcagaaaaatggacaaccaaataaaagaccggatgctctaaagccccggccttcccttgttaattatcctaaatacgctttcagcatccagttatgtttttcgatattctggtgaatggcaagcagcatatctccggtcgtttcgtcaccgacttcatctgcgagatccattccgcttttcagttcctctgcaatgacagtgaagtcatcataaatgttctgtaccatttgttctgcgctctcattgccttccgcttcttttatagatgcagtcttcaatgattccgtcattgtgccgatcggcttgccgtttaatgccagcagacgctctgccaagtcatcaatatatgtagccgtttcgttatacagctcctcgaacttttcatgcagtgtaaaaaagtccttccctttgacgtaccaatgatagttatgtaatttcacatacatgaccgtccagtttgcaacttgtttattgactgcttccaatagtttttctgacatgcctatcttcctcctttggtttactattgatataccctttatatcgtttgttaaaacataaatttttagcccttgattttacgtctggaaaatatgttattatttgttaaaaaggagggatttcatgctgcttcttctgagtctcggctttcttatcgtgcttgccgtgctgcttttatccatctggtcgaccgtaagagcctataatgtaaagcatacgattgatccgccgcaggacgaatcaaacggcttgacgcacaaaaacaaaccttaatgatgatgcgtctgttcctcatggccggaggaatcatcggcagcttcagcatctccgacacgcacttttacagtcggcatattgtgctgctgttttgccgttacgtgggattgaacggtatacacaccctcttcgtcaaattcagtccgcagatgatacgcccctttttcctccttggccttgcttgttttgctgctgcctttttttccttctttccatacttcaaacatgacttcatccgcatccgtgacgcgctttccgccgtaaaaaacatccgccttgtattctgctttttcatgcggctttaccgtttccggtcccgtaagcttgacctcaagcgctttaggcttttcatccgcggaggttttgtccgaattgcccccgcaagaagataaaagaaataccataccgcacatacctgccaatacagcccgtttcattccatcactccctcgtgtttgcttctattttagcaaacgcttacacataaggtgtgacattttttagaaatatgtaaaaaaagcctttttgcatgacagcaaaaaggcctgtttttttatccgaacactttcagcaaatcttctttatcctgtgacagccagaaacgcattaggcgtttcgcgccttccaaatcatgaagtttcgcctggccgcactgtttttcgttggctgccggaatctccgtaatatcgatggcttctttcagtgtagcgtcaagcaggtcaacaatctcttccgctgtcggctcaccgctcacaaccagataatatcctgtctggcagcccattggtgaaatatctatgatgtcgaagtgattgtatttctcagaatgtgtgcggatcgtaaacgcaagcaagtgctcaagcgtatgaatcgtatccggcttcatcgcctgtttgttcggctggcagaagcggatgtcaaacttattcacgacgccgtctgttccgactttatgcactccgcaatgtcttacatacggagccacaaccgcgttatggtcaagctcaaaactttctactgaaggcataatggcactccctttttttcagaatatgcacccattataacacagttttccgataagaattgcggcggacgcttttcaatctgaaattttttttctatactagcatcagaaaggtggtttttttgatgaaaaccataatgattgcgttaatccgcggataccagaagttcatctctccgctgacgccgccgtcatgccgcttttatccgacgtgttcgcagtacggaatcgaggccgtcaagactcacggcgcactaaaaggcggatggctgacactgaagcgaattttaaggtgccatccttttcatccgggcggggttgatcccgtaccggaaaaaaaacaaaagcattagtccatatgctgatagccgtcgatcaccagatcaagcttgccggtttcaggatcaatcacaagaccgtgcaccggcacgttatcagggaatagaggatggtgtttaatgacgtttacgctgtctgtaacactcgcttctacagaatcaaagcttttcagccattgatcaagatcaacacctgagtacttcagcatgtcaatccgctctttcggaataccgcggtcaataattttaccgagcatatcctcgctgttgattttgctcataccgcaatcatgatgcccgataacgcagacttcatcagcgtttaattcgtatacggccactaaaaggctgcgcataatgcttccgaatgggtgggcgacaagcgcgccggcacttttaataattttcacatcgccgtttcgcatgttcatcgcatgcggaagcaattcaacaaggcgtgtgtccatgcaggacaaaatcgccatctttttatccgggaatttagatgtttggtatttttcatactctttgtttttagtaaactgctcattaaatgtcatgatatcgtttagaagactcatcttggtgtttcctttctgcttttttattcacaatataacataaagcgggtcctttcgtcactccccgctcttgatgacaaagttgcagacggctcaaaaaataagacaaaccccctcgggcttgtcttatttccccatattgtattttttgttgaactgttcgactctcccgcctttttcgttgaacttttggcggcctgtataaaacggatgcgtatctgagctgacttctactttaatcagcgggtatgtttttccgtcttcccactctgctgtttcctctgatgttttcgttgaatggcttaaaaaccggtagccgctgttcacatcttgaaaaatcacttgatggttatccggatgaatatcttttttcatgctgatctccctttctttaaatcgtaattattacgctttattctaaaccttaaataggcgcttgtcaatcatatatgccccgatcccttgatttctaaaccctgcacatatatggaatcagaagaataatttaatggcttcagcaaataatataaccacattacataaaacggtaattagaaaggcggtttatgacgtggatgatttagtattagccagaagcctgttcgggacaaccatgggctttcatattattttcgcgacgcttggtgtcggtttgcctctgatgattttaatggctgaattaatttatcaaaaaacaaaagatccgcattatgccattatggcgaaaagatggacaaaggcgcaggctgttctgctcggcgtggcgataccgaccggaacgatcgcgggtacacagcttgcccttttgtggcccggattcatggaagtcatcggcagagtgatgtcacttccgtttcaaattgaaatttatgctttctttatcgaagcgctgtttatgtccatttatgtctatgccgctgaccggctgactccggcgatgcgcatcattgccgtcattttcgttttgatcggcgccgcggcatctgccgtcttaatcacaaatgttcacgcatttgaaggaacgccggccggctttaaaattttaaacggcaaaatcactgacgtcgaaccgtgggcggcattttttaatccaagctttttcaccaccgcgggccatgtcgttctgacggctttcatgaccggtgcatttatcgtcgcgtcagtagccgcttataaaatgctgagaacgagaaaacaggagcaggtataccgttttcaccggaaagcgcttctgctcgctttaacgatcggcggaatcttttctattattgcctctttaaacggacacgagtcagctcagctcctttacgaataccagcctgagaagcttgcgggcgcagaagggctgtttgaaacaaggtcacacgctccgcttgcgatcggcggttttaccgacgcaaaagaagaaaaagtaaaatgggcgatagaagtgccgtgggctttaagctttttggctgcaaacagctttgacacagtcgtcaaaggcttgaacgcgtttccgaaagacgagtggccgcctttattcatccatacactgtttaacggaatggtcggcatcggaatgctgctcattttgtactccgtcatcggcatcgtgtggagaaaaatattaaagaaagacagctttccgacttggcttttgattttatttttaaccgcgggaccgcttagtctgatcggcattgaattcggatggatattcgcttgtactgggcggcagccatgggtgatttatcatcttctgaaaacgtcagatgtcgtcacgacaactggttcaatcggtttgctgttcatcctgtttacggtggtttacgccattttggcggccgcagtcatttatgtgctgctgtattatttccgcaaacatcccgttgaggaggatgtaaaagcggcggaatcttaacaacagaaagggctgaattgaaatggacattaccatggatgctctcatcgcgatatccatcgtatggggcttcgtgtttatctacgcggttatggcaacgatggacttcggagccggtttttggtctatgatttatttaaataaagaacaaacaaaggcgactaacatcgccaaccgttatttatccccgacatgggaagtgaccaatgtctttatcgtcgcgatcgttgtcgcccttttcagtttctttcccggggcaactttcgtgctgggtaccgttttattgattccggggagtatcattttgctgcttttagctatccgaagcggctttctcgttttctccaatacggcgaaagaaagaaaaatcatgagatatatctccggaatttcaggcttcattattcctgctgtgctgattttggtacttccggtgacacacggaggatttatcgagaaaacgggcggggtgtatcacttgaatttggcaaatgtctttacaagcccgaatgcgtatgcctttatcggctttgccattttaagcactttatttttatcttcgctgcttctggccgacttttcaaatgttgcggaagaggagcatgcgtatcgcatatacagacggagctctttaataacagggccgctgtctcttctttttgcgatcttcattatgctgacattgcgtacggaagccggctggctgtatacgggaatgatgaaagacctgacatggctcatcctgtctgtcattacatttatcattgccggtatcgctctgtttttgccgaataaacgcttcggcagaaacctcggcaaaccgaggatcgccatgattgccattgcgctgcaatactttctggcaagctatgcgtacggacgggctcatcttccttatatgatttatcccgacattacggtcatgtcaggatttacggaacccgcaaccttcagggcgctgtttatgacgtatatcgtcgcgttcatcattttgtttcccggattttatttcttctggaagctctttatgaaagacagacgttatatccgccaggaggaataacaaaaatcggggcggctcatactaatggcgtaccttttatttgggaggggaatcagcatggaccaaaaaattctgtgtgaagtcaataactgctcatattggggcaaaggaaacaaatgcacggccgacgctatttatgttgtcagccatacaggcgaaaccgctgaaaaaagtgaagaaacggattgcaaaacctttaaaccgcatgatttataaaaaaaagagctgtttttatacagctctttttaatttccgcgccgcactgctcacatttatcaagtaaaaaaaccggctttaacagccggttcaaacggggaaggggtgatgatgaacagtttcaatataacagcggcatacagaatgctcaacttgctgaaatatcgttttatcagctgtttgtcgtaaaaacgtccatttgggtgacgtattttctcattatttcctgattaacttcgacacccagcccgggaccgtccggaacagagataaatccctcttcgatacggatgtcaggagtgataatatcctcctcccagtatcggtctgatgaggaaatgtcccccggtatcgtaaattgcggcagcgaagcaagcgccactgtctgcgctctcgaaatgccggtctcaaacattccgccgcaccataccggcatgtgatgctctctgcataaatcatgtatttttaaagcctctgtcagaccacctacacgcgccggttttatattaatgattttacagcttccaagctcaatcgcacgcctcgcgtcatcaaatgagcatatgctttcatcaagacatatcgccgttctcaagtgtttttgcaggtggcggtgatcgacaatatcatctgcctgaagcggctgttctatcatcattaattggaattcatccaattctttcagcctgctgatgtctttcagttcatacgctgagttggcatccgccatgagcggtacattcggaaaacggctgcggatggctctgaccaaatcaacgtcattgccgggctgaatttttatttttatacgttgataaccttcttttacgtattgctcaatttcccgaagcatctcatcagccgaagcaagacccactacgacgccggcgggcactttatcttttttgcctcccaaggcttctgcgagagaaatcccctttttcttggcatataaatcccacacggctgattcaaggcccgcttttgccatgcggtttcctttaaaacgctcgagacagtcaggcacgtctgacgggtgggaaaattcgcggcctacgacatttggaataaaaaaatctttcagcatatgcgcgcatgtctgaatcgtttcttctgtataccacggggaagaaaacgccgatacctctccccagccggttctcccggtttcgtcgatcgcttccacgatcaaaaatttacggtcgtgcagagtttcaatacttgttttaaatggtttttttagcctcatactcacatgataaagggtgattttttcaatcttaatcatgacaattctcctttacgaagctcattaagccgatgcctcatcagtttattggacgcgttccgcggaagctcgtcaaccgcgaaaaaagcagccggtattttatattttgcaagacgttcacggcaaaaagcggtcagctcctctgaactgacagaagaagtcaaaacgagaaaggcatgcggcactttcccccacttcggatcttcggctcctgaaacaccggcttccgctacagccggatgggcaagcagcgccgcttcaacttcagccgggtagatgttctctccgcctgaaatgatgagatccgaccgtctgtccagcacatataaaaacccttcatcatccaaatagccaagatcgcccgttttgaaccagccattatgaaaagcggcctgattcgcttcgtcacgatgatagtaccctttcatcacattcggccctttcaccgtaatctcaccaggttcaaacggcgcacagcgatttccgtctttttcaattctgatttcacatgaaaacagcggtttacctgccgagccgagcttttccatgctgaattcaggagaaagcgtgacaatctgtgagcaggtttcggtcaagccataagactggaagaccggaaattgtttcctgcggcattcttcaagaagcggcagcggtgccggccccccgcctagcagaatgcaacgcagtgattcaggacattgttcagtctccgaaagcagacccgacagcatggtctgcacagccgatatgatcgtgacccggtgtgagctgatgctgtccagcacatcagtgacagaaaatttttggtgaagcacgacaggcatgccgtaaatgaccgatttaaacagtgcagacaggccgctgatatgaaaaagcggcagcgcaataagccagcggtcccgctccgtgacccccagattcagcgcagatgatacagcgctggaataatggtttccgaaagtctgctgcacccccttcggccttcccgttgttcctgacgtatacataagagtcgccgtatcatcgagcgttacatattcttccggctcaatgtctcccgcctcttcagcctgcagctcgtccacatctgcggtggcgactgcagattcataatcttcccggcgaaaaccgtcctccgtcaataaaagcttcgcctgtgaatcttcgagctgaaacagccgttcttgttttgagagcttcgtatttaacagcaccgcttccattcctaataagaagcaggcgtgaacggcataaaccatttcaggtctgttagaaagcaaaatcgcgacacggtctccttttttaagcgtgtagtattcggacagccgcgcggccatttgtttagaagcatggtacaattctttgaatgtcatctgtttgttttcaaatatgagagcgattctctcaggtgtcagctgagccctttgaatgagccaatttggctgttctgtcagcatgttatcatctccgaggtaaaagtactttttttgaaaagaaaacagcttggaccagagcggctcaagctgtttcgtagtgtcatctgatcacggaaaacgagggaactgaccgaaatcgggactgcgtttctctttaaaggaatcgcggccttctttcgcttcgtctgtcgtgtaataaagaagcgttgcatctcctgcaaattgctgaattccggcaagaccgtctgtatctgcgttaaatgccgctttaaggaaacgaagggctgtagggcttttctcaagcatttcctcacaccatttaattgtttcctcttcaagtttctctaatgggacaaccgtattgacaagccccatgtcgagcgcttcctgcgcgttgtattgacgacacaggtaccagatttcacgggctttcttatgtccgacgatacgcgccaggtagcctgagccgtaaccggcatcaaagctgcccactttcggcccagtctgaccgaaaatcgcgttatcagctgcaatcgttaaatcacagacgatatgaagcacatggcctccgccgatggcgtagcctgataccatcgctacaaccggttttggaataacacggattaaacgctgaagatcaagcacattcagacgcgggatctgatcgtctccgacatatccgccgtgaccgcggactttttggtccccgcctgaacagaatgccttatctcccgctcccgcaagaacgatgacaccaatctcagagtcatcacgtgcgtaagcaaatgcgtcaatcatttctgataccgtcttaggagtaaatgcgttatgtacctccgggcggttaattgttatttttgcaataccgttatacgtctcgtacaggatttcatcgtactgacgttcacttttccattctgcagccattgatatgacctcctctatttttgcatgagtccggccgaaaagtcattttctttatgctttacaagccgtttaaaaactcacttactatcttaccaaaaattcgcggctgttccacatgaaccgtgtgccccgcctgtttgacaacctctattttacttgatgggagcaggttatgcaccttttgattaatgacgcaaaatttttcatcccattcaccgcatatgagaagaaccggcgatttgatgcggtctaatgcactccaccaggaaggctgtgagcccgtccccattccgagcagactgcctgcaagaccggacggattatttttcagccggccggcacggatggacgcctttacattgtccggaagagaaagctgtgtggcaaacaacggaatgctttcccaataatcgacaaacgatgttatgccttcccgtaatataaagtcagcaagcttccggtctgactgaatccgctttttgcgttcctcgagcgtgctgaggccaggagttgaactttccagaacaagcgctgacacccgatgcggaaatgtctgtgcaaaggagtaagcaagtcttccccccatagaatacccaataagtttcactttgtgaagttttaattgatcaaaaacggcggcaaggtccgccacctgccggctcgcactataccttgccgcttgcacaggcgcgtctgtctctccgtggcccaggcagtcaatcatcaccattcgctcgccgggaaacatttcgcgtaaaaattcccatgattctttactgcccgtaaacccgtgcagacaaactatcgcttcagacgattcgtgaccgctgtcagccgcccgatagcacacaccgtccgccattttgacagttacagcttccattcttttttcacttcctggactgcggcctgcagcagatcgcgatggaattgaactcttgatgtccgatctgttttcagctcgataatatgaagtccgggcttgtccgcctgcggctgatacgcatccttaaatgcatcccaagtctcagggcaagtatacgtcccgccgtacagtgcggcggcatgacggaaatcaagtcccgtcggcgtaccgaacagttcttcaaaatgagttttatcagatgcctgcggcaaaaatgagaaaatcccgccgccatcattgtttattaaaataaccgtaagcggaattccaagttttttagccgctaacagcccgtttaaatcatggtaaaacgataaatctccaatcacaagcgtgacaggcgcctttgttccctcacacagtcccatagccgaggaaacaaccccgtcaattccgttagcgccgcggttggcatagacacggaaggaacggtcttgtttttcaaagaaagtatccacgtcacgaatcggcatgctgttgccgacaaaaatcgaactgccctcaggaacaaggtgctgaagctgacgatatacatttccttcaaatgataaatcatccatgtccgcggcctttaaatggctgcggaaccgctcattgacaaactgccatttctccagccatccggacggccgtttttcagtttcagctgaacggaccgcttccaacaatacagacggatggcaatgaatcatatgcgcgccggtctgagtgggatctctccacccgccgtcttcatcaacgataaactgctcaatggcagaatcgtctctgagccataaaaagagcggtttggaaaccggcatcggaccgaatcggatcacaacgtccggacgcagcgcctcttttatctcctcatcttttaagaatgagtcataggcatcaataatcagcgccttatcatgctttccgtttcggagatttgaaagcgggtcagccaaaatcgggaattgaagcatctcggcaagcgcgatgatctgctgtttttctgcttcaccgtgaatttcgccgcagacgatcatacccttttcggcactcgcaagacgctctgtaatatgacgcagagaggcttggtcagctgactgaatccctgttgtaacagagacatgccgcccagctctcattctttcaaaaggccgtgctgacaaatccggcatcaaaggctctctgagcggcacattgacatgcacaggccccatcgggcgtttgcccgcttcacttacggctcggccggccaatgttctgatataactcagcatctgaggattttcctcaggaagagctgagtctgtgaaaaacttaacaaagttaccgaacagaaaatgctggttaatcgcctgaggcgcccctacttcccttaattcatgcggccggtcagcagtcaggacaataagaggcactcttgaataatgagcttcaatcacggccggatagaagttagccgctgccgttcctgacgtacaaatcagcatgaccggacgctggcgggcttttgcaagaccgagtgcgaaaaaacccgcggatcgttcatcaatctgtatatggacatgaatatccgggtgggccgctgccaaaaccgccagcggagttgacctcgatccgggacaaacgactgcgtcggttatacccgaaagagcgaattcatcaataaagcttccgatataatgtgtaatcgggtttgtcaaagcctttcacctcctaaagcagagatcatcggctttagtttaatttgtgtttcttcatattctgattgcggatctgaatcttcaacaataccgcatcctgcgaataggcgcgcactttgatcttcaatcagccctgatcggatggccacgacaaattctccgttttccctgccgtccatccagccgatcggagccgcgtaccatccgcgtgtcatcggttcaatatcagcgataacttcaacagctttttgctggggcgctccgcccaatgccggtgtcggatgcagcttttcaatcaaatcaaacagcgaagcggacgttttaagatgaccgacgatcggcgtatataaatgctgaacactttttgttttatatagttgcggacccgccggctttttcacatcactgcagctcgacaaaaaagcatcgtgtatcatctgaaccacaaaatcatgctccgcgagattttttccgtcatgcagcaattcgttgccaagacagtcatcttcttgttgattttttccgcgcttaattgaacctgccaggcaggacgacatgacgtctttgccggattttttgatcagccgctctggtgaagcgccgacaaagcatttatttccctgctcaatcgcaaaaacatagcttgtcgtttgatccgtcaaaagctttctgacaacgctctccaccggaataggcccatcaaatgacaatacgacttcccttgccagcacgactttatcatattgatttgccttcatatcatttgttgctgtattaatggcttcaagccagttttccacatcaagttcttccgcttttgttaaagcaggatactcctcatacgccattgaagaaactgcaaaagcttcagaaaaagatttcagacgtttcagcacatcttctgcctgattaccgtctgccgcccattgattgacggttaaataatcaccatccgccgtctttgtcagcatgagtgagggaataaagaacagtccttcttcgaacccgttccattcgtctcctctttcttcagcgggattaaatgaaaaaccgccgaataagacaggaccgaccgcggtatgcgccgcctcttcttcatgaatatgaaaagccgtctttttaaagcgctcccattgttcaaaaacgtcgtgataacgctttttgtttttttcattcgattggaacagcgcttctgtgccaagaccgactattgttaattcactaccgggttctgaccaaaaaaatcgtttgcctttatatttttttgctccgtctttgaaaaatgatagagggtctaaagacgcaatacgtcttgaatagctcaataagacagcatggttgacttgtttggctttatgtaatgcatgatctgcttcctctcggaacgtatgctgcaccgttgtcaccatgagacattcctccataatccgttaaatgcttttaatacaatacacctgtgatgacattgtgtcaaacacacagatgtgagcacgacaaaatgcctgcatttcttattataaacctttttgcacaaatgaataaagaaacaaacttgaattttctttccccactctcggcaaacactgtatccttttactttactgtggaaaagtgaccatttttatccaccttttttctgtatcaaaaacgttcatactaactgtaagcatcacatagaaacgagggaacgatgtgcttacaaacgaacagatcacacacttgaaaaaagagctagaagaagccaaacatgatattttaagccgttttaaagaaaatgatcaatttcaattaacagatgaattcccgtatcagtcatccggcgaattgtcttcctatgacaatcaccccggcgatcaggcaaccgagttatacgagcgtgaaaaagacctggctctcctcgaccatgaacgggagcatcttcgcgatattgattactccttgaaacaaattgaaaacggtacgtacggcatatgtgaagtcagcggcaaggagatcccttatgacagactggaagctctgccgactgctacaaccttggcggaatattcctcgcaggatgccgtttctaaagacaggccgattgaggaggaaacaccgttcggacagtttgaatttgatgatgatgaatcaatacggccgccatacgacagtgaagactcttatcaggacgttgagaaatacggaaactcagaaacgcctcaggatttagagaatccgcctctcagctacaacgatatgacaatgaactctgaagaaaacatcggctatgttgaggattatgaaaacttcatcgcaacagatattaccggaaaaaacatttctgtatatccaagcagagaacacgaaaaatatgaacaggaactggacgaagaaggaattatgacgacgttcggcgatcttcatgctgactaaaaccccggcttgccggggttttaagtttgcagcattattgcaatgaaaactcatacactgaaaggggtatgcgactctttaaaaagtttgacctttacaaaatcgggaatgaacgtattgacattgaatatcggaaggaatagatgaaaaagaagtatatcggtgcgattattgtatttatcattacatatgccttgttttctttagctgggtttctctttcccatcgacagggaatggtacgacgcccttcacaaacctgactggacgccgagcggatcagttatcggcatcatatgggcggttttgtttgcgtttatctcgctgtcagcagccttgatatacgcaaaattttcatataaagaatccaaagctttctgggtgatgcttctcatcaattatatcgttaatcaaggattcagcttttttcaattcacacagaaaaatttgcttgctgcatctatcgattgcctgcttgtggccgttacaacacttagcttattgataattgcccgcaaatacagtaaagattcagcctggctgctggttccttatttattatggagtgtttttgccacatacctgtctttcaccatttacactatgaactcataataaaaaaccttgcatactatgcaaggttctttaatgacccgtacgggattcgaacccgtgttaccgccgtgaaagggcggtgtcttaaccgcttgaccaacgggccttatggcggagaaggagggatttgaaccctcgcgccgcttacacgacctacacccttagcaggggcgcctcttcagccacttgagtacttctccatatggctccacaggcaggattcgaacctgcgaccgatcggttaacagccgatagctctaccactgagctactgtggaaaaatcatcatggtgggcctgagtggactcgaaccaccgacctcacgcttatcaggcgtgcgctctaaccagctgagctacaggcccatgacaataaaaaaatggagcgggtgatgggaatcgaacccacgacatcagcttggaaggctgaggttttaccactaaactacacccgcattgttgtttggggcgattgatgggaatcgaacccacgagtgccagagccacaatctggtgcgttaaccacttcgccacaaccgccaaaacaatattaaattaagatggtggctcgggacggaatcgaaccgccgacacacggattttcagtccgttgctctaccaactgagctaccgagccttttttataaatggcggtccggacgggactcgaacccgcgacctcctgcgtgacaggcaggcattctaaccaactgaactaccggaccattttttggttgcgggggcaggatttgaacctgcgaccttcgggttatgagcccgacgagctaccgaactgctccaccccgcgatgataattaaattagatatggcggaggaagagggattcgaacccccgcgggctttgacacccctgtcggttttcaagaccgatcccttcagccagacttgggtattcctccgtatatgtggtggaccttgtaggactcgaacctacgaccggacggttatgagccgtctgctctaaccaactgagctaaaggtccaatggtagcggcggaggggatcgaacccccgacctcacgggtatgaaccgtacgctctagccagctgagctacaccgccaaaaaacaattaaaatcaactgcgcaaacaccaagattggtccggtaaatactgtccgcatcgtgtgttagcggaaggccgttgggaagccgtaaaagcggcaatcgcagcggaactcaaagcgctcggcggcaagtcttccgcaagcaagccggccaaggcatccggatcgacatacaccgttaagaaaggcgacactttgtccgaaattgcggtgaaaacaggcgtcagtatggcgaagttacaagcatacaatggcattaagaacgcgaataagattacggtcggccaagtattaaaactgacgggggcggccggttcttctaaaccgtcatccagcggtaagaaatacgtttaccttccggcgtctgccgactcatggcgcatctatcctacgaataaagcgccggtcaaagggaacgaaattaactatttgcgtccgaaaaaattcggcggccttaaatacgaaatccttgcgaatccgcaaacggacgtttacacgatcaagacggatcagttcggaaaggtaaatatctatgccggaaaaataacaggcgcaacagtaaaataaacgaaaagggagacgatgattatggaagaagtattgattttcgcgactatcctcgcgcccatcctaacggcgctcgttcagctcgttaagaaaacggttaagctgccgacgaatattgtgccggctctcagcttcgtcatcggtatcggattgggcgcgattgcctatccgtttacggatctcgacttggtgctgcgtttatgggccggtggctttgcgggtctggccgcgacgggtcttttcgaaatcggaacaaaacgagagggaactacgaaataaaataacggaactttttgcgagcgcttgcgtatgaatacgtaggtgtccgtttacataacgaacaggtattgcggaaaaagatggtcggatagtataatttaactacgaataggggaggcgtggaatttggttaaatttattcaatgcgttggatgtgctatacttgtagtaggtattatcgcttttttgtatcttggattcggcttgaaaacatatacaccgggtttatcggaaggctatacgtatgccgaaccgcacccgctacgatggatttacgctacggcctcctttttaggggcggctttcttcggcagcgtgctcatcgggctggctcgtattttacaccacaaggaatccgattctagttacattcgagaaatacaaaacgacctccgcctgatgaaagcgcgcgagggaatttcgaaataataaacagccctatccttaaccggatggggcgttttttttgtgcacatgtggataacaacgcttgtcattcgaggaaagtttgggtattatggtgttaacgagattcgtcgctaggaatacgcggcgttaacaatctaaacgaataataacaatcgtacaaatcgtacataaacgttgatatgatcgggttttcatttaacgtaaactgatcgtatgattcaccattgacaatccgaatgccatcgcttcctgcggctgcggttcttctttccgcacggccaaaaatgccggtacgccggaagagtgctaagggattcataggattagtgatgacgtctttcttttcgatggaacttacaccgtcgttaaggaaggcgtttttattatagcggaaaatcaaatatcgcggatagttgcggggcaggcaattctttttaataaagaaaacccgcttctgttgagcgggttttactttttcaaagatgttattcaattgtatgtttcattgcattgtacatattttccacgtgctcatcagcttgatcccgtgacatgcgcagccgttccactgaagaaccataaccgatttcttgtttgccctctttaagtcctttaaaaatcccatcagcgaattcatctagcggttcgccttgagtatgcagccctgctccgcctaaatccgtattcactgccggaggcgcaacttcaataacttctacagatgaatcagaaagctgatgtctcagactcatcgtaaatgaatgaagtgccgctttcgttgctgaatagatcggagcaatggcaagcggtgtaaaagctaatccggatgtgacgttaatgacagccgcattttcttttccggcaaaaaccggggcgaacaacatagacagatggaagggagcttcaatgttcgtggtgatttctttattgaaataatcccaattgtccttcgcatctgcttttaatacatgaaaccgctgctgaatccccgcgttgttcactagcacattcacttccggatggttctctgtcacccaatcaaacaatgatacacgttcagatggaatgctcaaatcactgacataggtaataagttccggacatttttcttttgctttttgaagagcatgttcacggcgtccggtaatgatgactttatttcccgctttgacaaagcgttctgcgaaagccaatcctatcccggcatttccgcctgtaatcagtattgtatttcctgttagtttcattttaactcctcttttccaattgttttctcatttctttgacaaacattcaccgctttcaagtcgaagttcaattaactactatccaatcaatatattgctaaaataaccgtttcaaggatcgaaacattacgcacaatcaacagcagcagtgattctgtaaaattgaattttgtgcatcatcggaaaaccgccaaaactattctttccttgtcacaggataatgatacgactttaagtatggtttaagtcaacaaaaaacttgtgttgccgttccggttaaaaaggataaagtctgggatttttcttgattaccatataacattggataagaggtagtgctgattattataagccatgtaaaaggatgggagacttatgcaggaagaaaacgccattgttatcagaccgctcagcctgaatgatgcagagcgggaactggttctgcagacggaaaaccgcatgttttttgaacagtttgccatgtcgagacaagaggacttttatacgctggaaggccggaaaaaacgaattgaacaatcactgaaagatgcggaaaatgatacagaatacagcttcggcatttttcttcaggatcagaccctgattggcacgatcagtctttttcaggtggttcggggctccctccaaagcgcttttatcggttacttttaagatggaaaacataatggaaaaggctatgcgacgaaagctgtcaagctgattgttgaatatgcattcaatgagctgaaactgcatcggatagaagccggtgtcatgccgcacaataaggcgtcaatccgggtgctcgaaaaagcgggctttcataaagaaggcattgcgagaaaaaatgtaaaaataaaaggaaaatgggaggatcatcaggtgctggcgatcattcatccggaggataaataatgatatcctctttttttatcccgcgtctcattcctcaggtattcttccaaaatcctcaaatcaattgtttgaatatactatttgcaaactcggataaaaataaagggtatataggactaaaatttctgaataatatcctctttaacaaccattccaaagtcatattttcgcgaaagtatgttgattttttcataggaataaactaaattgtaaaagtatagaatagttattttattttgtaagaaaaggatgataatatgataggtcaattgagcaataaaaaaatatttttaagttcttttttcatcattttgatctgttcattactcttccaatttagtatttcagataaagtgctgcaggcatattactcttctgtcggtgaaagtacctacgatatcggggagaaaagtgttcgtactattgtcatgtttttgcaagggtttatgatcttcactacttttgtggaaattctgataggcggatttctgttatttgttgccgcttttattcttggttcaaagaaaccgaaaaaaacatatttgcttctatatacactgacttctttaatctcggcatttaaaatgttaattctatcagttgttaactatgtaacggctgattcctcacttatatattctgccggcggctcaaaattgagtttacagctgctggacccgtttctgcttctatcaatcgcggctttatatactgccgcaggaaaacttaccgatctcagtaagaaaaaaagaatcattttgactggatgttttattttattaaaactcttcactattttctttaattattttatggcggataaaatttagctcgggagagagtaaatgaagctgaattttattatatattaaaaagcagagtagggagatgttatgatgaacttagtaaaatctaataaaaaatctttcattttgtttggcgcggcactagctgcagcaactttggtttatgcacttttattaacgggaactgaattaaatgtggcggcggctcatgcattctcagccaatgctgaattagcttcgactctcggcatctctacagcagcagctaaaaaagcaattgacattattgatgcggcatctacaattgcttctattatttctctcatcggtatcgttacaggcgctggtgctatttcttatgcaatcgttgccacagcaaaaacaatgattaaaaaatacggcaaaaaatacgcagctgcttggtaaaatcgatcaataaataattgctctttttgtacaagctgcaaaaagagcctctctcccaaatacatatgtaaggattgaaagtatgatagtcaaacaaattgcggctcttatcaaatataataccctgtcatcgtttcgcaaaagaaaggaagattggggaattcctcaactcagcagcaaactgctgtctgccattattatttctctgttatgtgtttatctcattttactgggatgcggtgtcgtattcgggacaaaactgattcagctccctctcagcgcatggggacaatttgttttaatcgccgtttcactggagcagcttttttgggctgccggcttctttaaagaacatcaaaatgcctttctgctggatacgcgcaaggtcattcatcaattaaaaaaggttcgttttttacagctgttttctgtttttaccggccaggcgatcaaaaaaaccattttcgtatggtatctttttgtttttccggtctttttgtttttatcaagcgcaggcatgactgggtctgcagcggtcatcgtatttttcctgggcttcgtttattttcttctcaatctatttttatctatgctgttttcttacgttgtttatcttcttacgaatatgtggagcaaactattttacctgaaaatcttgaagggcatattattcagcgtcagtctgctggttccgctggcagtcgggtatgctgtttatctgctcgtatttggggagtacacggtaaaggaaatctctggatttacggagtcaccggctttccggaacatcctcatgaatacgccgtatgtattgttagcattccgctcccattccgtgctcgtcttcgccgcggtatttgcggcagccgtccttttaacggcggggctgtttaagctgtggtcggccacattgaagaaaatggaccttatcccttatatgtttttgacaaacgctgattttgcgccaaaactgaaattatataggaataacaaaatatttcatgccgtttttcaaaaggatctgctgttcttatcgagaattgacgggtttttcatcagaaatttcggcagtatgctttatttgttcatgctgtttttaggtttttgtgttccgctgctctcccatcatttcaccgggtattcggcagcggccatcgtatccgcggcggttatcattgcgaacttttcgtatcagctcgtcggggatgcgctcaaaacagtattatcagttgacggagaaatcaaaaatcagcatctgtttcaccggaatattaaacatgcgtggcagcttgtgtttccgaaagtatgtatttataaccttgcggctcttatctattcgatcatcatcaccattttgattacggtgttttttccgtctcccgctgcactgacaatctacttgtttattgtatttttatgttctggttttttatacagtcttgttcagatttcaagcaccgctctgtatccaaagaaaaactgggagcacctgtacgaaattggagaagcgggaaaagcaaagacgtacaacaacttatacggttctttgattttcattgtgtcgcttcaaatcgctgcgatcacgtcgtattttatctataaaaagccggaaattgaaacgatgcttattcattctgcatcaggtatatttgtcctgttcacactattaaactatggagtcatgtttctgtttcttcgcagaatcaatatggcggaaaggtttgcgaacaatgattaaattagtaaatatacaaaaaaactatagtgaaaaacaggtgttaaaagatatttcttttgaagtgaagaaaggctcaatttacgctttgctggggaccaatggggtagggaaaacaacgactttaaaaattatctcgggcctgcttaaaccgacttcaggccgcgttgtgattgacggcaaagaaatggattcagaagagggggggcaaatatcggctgacatcggttttgtgcccgatcatacctttttgtatgattatttaacgggagtcgaatacttgcgttttacagctgagatgtttcaagtgccgtcccagcggacaaatgattatataaagaaaatgctggagatgctgaagctttctcaggacggtaatcagttgattaaaacctattcgcacggaatgaaacagaaattatcaatcgcggccgcgctcattcatcagccgaagattttaattcttgacgagccgctgacgggcattgatttaatcagcggcaaaacgatacggacgttgttaaaagagtacgtcaaacaggggaatacggttcttttatcgactcacctgctggagctggcgcattcgctgtgcgatacgatcggcattatacacgagggcgtttttgcggcggagtatcagtcagccgagcattcattagaagagattgaagaaatggctgagcgtatctatacatgatgaatcgcattttgccggcaatcaggacgtccgccattccgttaaccgcgtcattgctgtttttttcaggcggtgtaatcgctgcggtttttactgatcactttgtttcatcagcgtcttataatggctcgtcaggcgcggttgaactgttaaaaaataatgccatcgcttgtctgtttttagcggcaggtttttttactttcgggttaacctccatcttttatttattcaccaacggttttattttaagcggctctattatagaaaatctgcacagcgggatgcctttatatcagattattttactgctaattcctcatggtatatttgaagttcctgcgttattattaagtggcgccattggttttaaaggcgttgaattgatcatcagactgtgtttttctaaggaaaaaaagatattgagatcaatgttcaggcatatcggaatattggtgatgcttattatttgtctgctgatcgccgctgctattattgaagcttatatcacaccaatttttaagtaaaaggggcagaaatcatatgagaagcaaattatcattaatcggtgtgccgattgttatgattatcggttatttcatttctttatcttttgagtggctgttccctgtccttacttttggggcggcagggctgtatctctttatatttgccccggtgcaaaataaattcattcgttacatatttctgtttatttttgtgattaatctgttagccagcgcggctctttatttccgcatttaataaaaaatgacattcttattgaatgtcatttttttatctttgagcggctttgctgcgtgttaaaatctgtcgccgttgaaaatagagtttttcacgatcacgtagtcgacattgcggatggcttcgagtttattgccgccggcgtaggagatggaagattgcagatcctgctccatttcaatcagcgtgtcctgcagagaccctttatgctcgacatgcatttttttgccctctacatttttcttttcgcctttttgaaattcggaagcggagccgaaatattctttataaagctttccgtcgatttcgaccgtttgtcccggtgattcctcgtgaccggcgaataatgatccgatcatgaccatagacgcgccgaaacggatggacttcgcaatatccccgtgcgtgcggatgccgccgtcggcaatgatcggtttgcttgccgcttttgcgcaccagcgaagcgcggctaattgccatccgcctgttccgaagcctgttttaatctttgtgatgcagactttaccggggccgattcccacctttgtcgcgtcagcgccggcgcgttccagctcccttacggcttcaggcgtcccgacgttccctgcaatgacaaagctttccggaacatgttctttaataaattggatcatgctgatcacggcattggaatgaccgtgcgcgatatcgatggtgatataatccggcacaagctgctgtgctttcagctcccgaatgaattcataatcattttccttcacgccgacactgatggaagaaatcagtccgcgcgctttcatatcctgaacaaaagccaggcgtttttccggctcgaagcggtgcatgatataaaaatacccgttttccgcgagccaggcagcgatgttttcatctataaccgtctgcatgttggctggcacgaccggaagtttaaatgtgtgtccgcccaacgtaactgatgtatcacattctgaacggctgttcacaatgcattttgcgggaatcagctgaatatcttcgtaatcgaatacattttccatacataacacccctaaaagcgaataataaaattatatcaaaaataaaacgttcgtctttttataatgtactttgttttgtcaggaatgtcaaatgatttcatgctgccttatatgcggtcagcttgtcatccaattgcagtttggttatcatagtagtattgattgttgtaaaacacttgtcacgatagatagttttgcagaggaagggaggggccggtgtggaagaaaaacagcccgggcacagtccgaaagcccagaaaattcaggaccggattattttaggcacgatttgggtcgtctcagcgcttgtcattgcgcttgttgtcggaactgtcatgaattatatttggatgtttaaataaaaaagagtctgtgccgatatgacacagactcttttttatattatttttcaaacatgcttgtagaatgcagaggctggacgcgcgctttcgggtccatgtaagccttcgcgttgttcacggctgtcggagcttcgccgaaaccgctggcaatcagcttgactttgccttcatatgtgcagatatctccggcggcaaagaagccttcaatattcgtttccatcgtgcttttgacgacgatggagtttttctcgatttcaaggccccagtttttaatcgggccgagagaagaaacaaagccgtagtttacgatcaggtcatcaatttcaatgatttctttgcggtcgcctttcacttcttcaagaacgatctgttcgatccggtcttcaccgacaagttcagtcggaacaaacggtgtcagcacgttgactttagaattgtgcaggttttctacactgtgttcatgcgcgcggaatttatcgcggcggtggatgatgctgacttctttcgcgatcggctcaagcatgagcgcccagtcaaccgcggaatcgccgccgcccaaaacggcaacgcgtctgcctgcgaattgattgaggtcgtcaatgaagtagtgaaggtttttgccttcatattgctccgctgattcaagctcaagctttctcggcttaaacgcaccgtttcctgcggtgataataaccgtttttgaatagtgcgtttctgaatttgtgacaagcttaaacacaccgtccgcctgtttttcaacagattcgacggcctgctctaagcagatggtctgctcgaactttgccatttgctcttttaagttgtccacaagttcttgggcgcggattttcgggaatccggctacatcataaatatatttttcagggtacagcgcgctgagctggccgccaagctgaggcaggctctcgatgattttaacgctcgcctgtctcattcccccgtaaaaagcggtaaacaggccgaccgggccgccgccgatgaccgtaatatcataaacctttgaatcctcttgcataccaaattgcctcctaattgaaaattgttattaattataacatacaaattgaaagaatgacgagtgccgaaaaccgccaggccgcttcattcttgaaaaaaaacgcggccgccgctaagatggggacaaattccattctgttttttcctgaatgttttccgactcttccggatagtatggtgatatgcagacatgtgcggttttctaaaaaatttataattcatttcataaaatcccgccaataagctgaagctaatacaaatgttgatttgattatgcgtctaacagcaaaaaaaagaaggtggatgtgatggcattgaataaacccaaaatcgtggttttaggtgcaggttatggtggattaatgacagtaacaaggcttccgaaacatatcgggacaaatgacgccgacattactttggtcaataaacacaattatcattatgaaacgacatggatgcatgaagcgagcgcaggaacgctgcaccatgaccgctgcagatatcaaataaaagatgtaatcaatgaatcacgggtcaaatttgtgcaggataccgtaaaagcgatagatgttcaaaataaaaaggtgacgctttcacaaggggacatcccttatgattatctcgtcatcgggcttggcgcagtccctgaaacattcgggattaaaggtttaaaagaattcgcctttccgatcgcaaatattaatacgtcgcgccagctgaaagaccatattgagctccaatttgcgacatacaatacggaggccgaaaaacgccctgaccgtttaaccatcgtcgtcggcggagcgggatttacgggaattgaatttctcggagaactcgcgaaccgcaagccggagttatgcagaaattatgatatagatgaaagtctcgtccggatcgtctgcgtcgaggccgcaccgacggttttgccgggatttgatccggagcttgtggattatgccgttcaataccttgagagcaagggcgttgagtttaaaatcggcaccgcggttcaagaatgccgcgctgacggtgtcacagtcggcaagaaagatgaagagccggaagaaatcaaatcgcagaccgtagtctgggccgcaggcgtgcgcggacatccgatcgtggaggaagcgggttttgaaaatatgcgcggccgtgttaaggtcaatcccgatcttcgggcgcccggccacgataacgtttttattctcggcgacagctcgctctttattaatgaagagacggaacggccgtacccgccgactgctcagatcgcgatgcagcaaggagaaacagtcgccaaaaacctgggccgtttgattaaaggaggccagcttgaagagttcaagccggacattaaagggaccgtcgcctctctcggtgagcataacgcggtcggtgtcgtatacggcaggaagctcaaaggcacgccggcgtcctttatgaaaaaggtaattgacaaccgctcgttatttatgatcggcggcctcggtctgacattgaaaaaagggaagtttaaattcttctgaaaacccgcggccgcgggttttttcttctctcaaaaaagagcgctgcgaaaagcatgtaagagaaaaaatgaatgtttccgcttacatgagttgatttgttacatattctgacttggtgcttgacaagtaaatatgatatattatcagaaaattaagaaaaagggtgatccgcatgaaaacgacagcaaaaagcactgcggcatgtccgttctgctcaggtaaagggtattttcaattgcttcttggcggctccgaaacatgtccctcctgccggggaagcggcaaagagagacgctgatttttccagacgttgacttttttaccgcccccgaggtacactgaaagtgctgtagggggtggatgtttgtgattagtttgccggtcgtcctgatctcaatcgtactattttttgtactgtttttcggcattggctttctgttgaacatgctgctgagaatgtcgtggattatggctgttatctatccgattgtatgccttttcattatcagcaataaaaagatgatcagttacgtgcaggcaccgggggaatcatttcaaagcctgtttcagcgcatcatgtcattagcagccgcagatgtcgtgattttggcaggcggactggcgggagccgtcatgtcaggcattgccataaaggcgctcagaaaaagaggatatcaaatgttttaagccgctttcttattcgagaaagctttttttgtgtttgtatagcgcctcaccgagttgggaacactgactcggaggagaggtgatttcagagtgacgataatcagacgcgtattcatgatcgtgctctttttaggcgcgtgccatgcgacatacttttccataacgggtgttgaagcaaaggatctgtcaaattggatgacggaacatcgcggcgccgctttgaaaaacatcggtattccgtttcagtcattacagaatcagccggaaaagaaggcatcaggcaaggtaaaaccactggaagaagcttttgactggaaccgttatccgtctcaaaaggtgacggccacaggttataccgccggagcggaatctacgggaaaatctccggggcatccgcaatacggaattacatattcaggcgtgaaggtcaaacgtgatttatattcaactgtggcggccgatccgtctgttttcccgatcgggacgattctgtttataccgaattacggatacggggttgtcgccgataccggttcgaaaattaaaggcagccgccttgatctttactttgacaccgtaaaggacgtctataacaactggggtaaaaaaacacttgaagtctacatcattaaaaaagggaacggcacagtgaccgaggacgaacttgtaaagctgaacgaaacaaagtcgctgcaagtgttcagaaaccaatacaaaacggtaaaagaataaaaacgcttcagcatccgctgaagcgttttttacataaagaaataatctaaaatcagagtcagcacaataccggtgacgccgccgaagaacacttcgatcggctgatggccgagcaattctttcagttttttctgtttttctttctcttccgctttcggaaagtccttcgcttcgctgacaaaccggttaaaatcgataaccagcttattaatgaccgtcgcctgttcacccgcatgccgccttacaccggtagcgtcaaacatcgtaataacggcgaaaatcgcggcgactgcaaacaggggggagtccagtccctgttccaaagcgactccggttgacagcgcggtgacggcggcggaatgggaactcggcatgccgccggtgctcgtcacaagagtccagtcaagttttttggatacgataaattgaataggcacttttacaacttgggcaaaaataatggcggcaaaactcgccagtaaaggaaaattcataagtacacccatatgcgacatcctttctgtatctgcggagtccgatcgtatcgaaaaactgcagaaaacgcccttagtttggtaaaataaaatcaatggaaaaatgttttttcattataccactttacataacaaatacccacataaggagtgtgtactcatgttttatgcatctgatcaattgcggcatcccgaaacacttgtcatcggtctttttcaaaaaagcacgctgaacggatttacgaaggaattggatgataaactggacggacatctgacgcagctgttaaaggacggtgatgtgtctgccaaacgcaatcgtgtatcaaaagtataccctccggccgcaaccggtatgaaacgtatttattttatcggcttgggaagggaagcggattattcgtttgaagatacgaaggaatgcttcgcacgcgtgtttcagcagattcatcaagataaaaaacaggaagtatccgttttgcttgatacattcgtctccggcgaagtgcctgccgccgatgccgctcatgcgctttcagaaagctgtctgcttgcggtttatgaagtgcaggattataaacataaatcgaatgagccggatcaggaactgacttcagtctgcgccgtgacggaagaagacctgagggaagtgcaggccggcctgaatgtcggcgcggcatacggtcaagggacgaattcggcccgcacgctcgtgaatatgccgggaaatatgctgacggccactgatctggcctcatatgccgctgaacttgcggcgaaatatgatttcgagtgtgaaattttggaaaaagatgaaatggaagagctcggcatgggcgggctgcttgccgttaacaagggctcatctgaaccgccgaaaatgatcgttctgaagtatcagggcaaagatcagtgggaagatgttatcggcctggtcggtaaaggaattacctttgatacgggcggatattcaattaagccgaaaaccggaattgtcggcatgaaaagcgatatgggcggagccgcttccgtactgggggcaatggaaattatcggcgaactgcggcctgaacaaaacgtgctcgccgtcattccgtctacggacaacatgatctcgtccgatgccatgaagccggatgacgtcatcgtctcgctcagcggaaaaaccattgaaatcctgaacaccgatgcggaagggcgcctcgtgcttgccgacggcatcacatatgccaagcagcacggagcttctgtcctcgtagacgtcgccacattaacgggcggtgtcattgtcgccttaggaaacgaaatgacgggcgccatgaccaataacgccgcgttttatgaacaggtggcagaatcggcgaaagaatccggggaaccgatctggcagcttccgattacagaaaaggataaaaaacgggtgagaaacagtcagatggctgatttgaacaattctcccggaagagaaggccatgcgattatggcggggacattccttggtgaatttgcggaaaacaccccttgggttcatctcgatatcgcgggaaccgcgacagccaataaagcgacatgcttcggccctgccggcgcaacaggcgtcatggcaaggacgttggctgttttgactgaacggtttactccagaaaaataacagcagcccgctgccttgatgcagcgggtttttgatttccaaaatctttagttgactaaagcgcggaatatatgttaactttaattatctactacattagcaaactaaagggtttttggagggacatatcacatgaatgctgttgttgtcgcagtactgcttatgctcgtcttaagcctgctgcgtgtcaatataattatagctttaatgatcggagcgcttgccggcggactgaccggcggcttaggcctcggtgagacggtgaaggcttttacggacggtctcggcggaaatgccaccgtcgcggtcagctacgcgctgctcggagcatttgccgcggcactgacaaagacggggcttcccgatgcgatggtcgaagcgtctgtcaaattaatcggaaaaaaggaagattcgcggaaaaaagcactgtctaaagtgttaatcgtactcattattttaatcatatcctgtttctcgcaaaacgtggtgcccgttcacattgcgtttattccggtactgattccgccgcttttaaaaatatttaatgaactggaaatggaccgcaggctgattgcgtgtgtgatgacattcgggctgactgcgccgtatatcgttctgcctgtcgggttcggacagattttccaggggatgctgagagataatatggcatcagccggtttaaaggtgccgctcagtgatatcccgtacgctttaatcattccgacggcggggatggcagtcggtttaattttagccgtcatcgtctaccggaaaccgaagaaatatgagacgaaggaaattgcgggattatcgtcttctccttatacgagaaaaagcatcgccatcgccctgatctccattggcgtatcgcttgccgttcagctctatctgtctcaggtgctcggagtggaaggtatgatcatgggcgcgcttgccggcttgtttacgctgtttatcagcggagtcatgaagcgtaatgaagccgataagctgattacggacggcatgattctgatggcctttatcgggtttgtcatgctcgttgcagccggtttttcaaatgtattgaacaaaacgggtgatgtggcttccttggtcaaagcatcaacagggttgatcggcaacagccaatcattgggcgcgctcctgatgctcgtcgtcggtttgctaatcacgatgggaatcggatcgtcatttgcaaccgtacccgtcattacgacgatatttgttccgctgtgcgctcaactcggattcagcccgatggcgacgatcgccgtaatcggagcggccgccgcggtcggtgatgcgggttctcctgcaagtgacagtacgctcggaccgacgtcaggcctcagtgccgacggccagcaccatcacatatgggatacgtgcgtaccgacatttattttctataacattccgcttgtgatattcggctggattgccgcacttgtcctgtaaaaaaaggctcccggaaaggggagccttttttgtatggcctaaaaatacttacgcaggatttcgattgaaccccgtcgctttatgaacggatctgtaaacggcaggcgcgatagatgccaataacagtgctaaaatgatatcttttatgaaaaaccaaatcatataaaaccaggccattccgtagctgatcggagcatgaagccataatttcagcgcaatatacgtataggtcgtgccaatgatataaatgacggcggtgccgatcaaagaggcccatgcataatgcaggcggccgggttcttttgttttttccagcagccatccggctgcaaatgccgccgggatgtaggcgagaataaatccgccgctttttccgataaacggcgcaaagcctgctgagaattgagcgaaaataggagcccctgcaagtccggccaatgcgtataccgtcatcgcaatggccgcccgtcttgcgccgagaagcatcgcagctaacagacaaaagaaaggctgcagtgataacggaatccccgcaacttgcaaaaagggagccattgatgtaatgttggcgccgacggccatcagtgcggcaaacatgccgataagcgccatatcgcccgcgcgaagattgcgttgtttcatttgattttcccccttacacttgtaccagattagcgtaatcgaaggaaaattaattgtcaacacgaattttatataggtttactaaatggagggagccatatgtttttcggaaaaacgaaacaaacaaggcagtcggatcggattccgccaaaccaaaatgtcacaacgaagtttcccgtgcttcacgccggaaatgttccttattatgaagatatgtcaaaatggaatctgcaagtgtacgggcttgtcgaccatccgatgctgttaagctttgaagatatcaaagcctttccgaaagccgaattgaaaaatgatattcactgcgttacgggctggtcccggcttgataacgtctggcagggaatacgcgcgaaagatatcgccgagaaagcgggcgtgcatgaagaagcgggtttcgtcattttgcacgctgaagagggctggacggccaatctgccgctttctgattttatgcgggagacttccctgctggcatatgcgtttaatggagagccgttaacgccggagcacggctatccgctcagaggcgtttttcctcatctttatttttggaaaagcgctaaatggctgcgcggcattcagttcacaaaggaaaaccaccccggcttttgggagaaaaacggctatcatatgaggggagacccatggaagaatcagcgctttacatgggattaagcacatatcaacatatagttcttaggtaccttattagaataaggtgctttttttatatcaaaaatccattgactttgtttggcaaaaaacctattatttgaggtgtcttttgatattgaaaatcattatcaatgagaatagataaagcaattgtcacagaggggatgaactcataatggacggaaatcaaacaaagcggggttccgcgccggccggtcgatatgcgatgccgggcacagaagtaagagaagtgcgttcaaaaggaggccgtacgtatcgtctctttgtctcttttcctcaggaagaaccgcctgcatccggttttcccgtcatatacctgctcgatgcgaattccgtgttcggaacaatggctgaagctttacgggtgcaaagccgccggcctgaaaaaacaggcgttgtcccggcggtgattgtgggaatcggctatccgactgatcagccgttttccgccgaacgccacagtgattttacgatgccgctctctgaatcagaactgccggtgcatccgcgcggggcggcgtggcccgagcagggaggagcggaagcgtttctggcatttatagaaaaagaagtaaagcccgcggtggagcgggattattcgatcgacagagacaggcagacgattttcggccattcgctgggcggtctttttgtgctgcaagtgcttttgacgaggccggacctgttccggacctatgttgccgggagtccgtcaatccactggaacaagcgctttattcaggaagaagcggagcgtttgtcagaacggatctctgaggaacatcttcaagtcagcgtactgctggcagcgggagaaattgaaaagacacataaaagcaggattccgcagcacgcagaggagctgtactctgtattatctgcgtttgaaggtgacggagtccgcgctgaatactgcgagtttgaaggagaaggccatatctctgttctgccggttttaatcagcagagccctgcgtttctgcctgaatccgggagggccgcataccccgtattccccttcttgagaaaacaggcccttcgaactaaatgaggctgattctaattttctaattgactgagtgttttgatttggatatgattgtcttgaaccacaattgataatgataatcattatcaatagagaaagggaatgataatatgaccgcattgggaatgaaagggaaaacggcagttgtcaccggcgccgctcaaggcatcggagaagcaacagcgcttgcccttgctgaacaaggagtaaatgtggcagctatagatacgaatgaaggcctgcttctcggtcttactgacaggctccggcaaaaaggcgtccaagcgcaggcttttgccgcagatgtatcagacagtgcggctgtcaatgatatcatcgccgccgttgaacgcgacatggggcctattgaaatattggcgaacgttgcgggcgtactgcggccgggtccggtgcattccctcagtgatgaagattgggctcaaacattttcagttaatacgaccggcgtgtttcatgtatcacgcgccgtcagccggtacatgatggagcggagaaagggggccatcgttacggtcggttcaaacgcggccggcgttccgcgcgcttccatggcggcttatgcggcgtcaaaagcggctgccgtcatgtttacgaaatgccttggactggagcttgcggcctatcatatccgctgcaacatcgtatctcccggttcaacggaaaccgagatgcagcgggcgatgtggcaggatgaaaacggagcaagggacgtcatcagaggttcgcttgatacatataaaacgggaattccgctacaaaagctggcaaagccttctgatattgcaaatgctgttttgtttctggcctctgaacaggcaaaccatatcacgatgcatgacttatgcgttgatggcggtgctactttaggcgtttgatttacgagaaggagggacaaacatgacaaatcaatatttattgacggaagtgtctgcaaaagaggtgcttgacgcttacaagcccggtgcgttctttttagcttccccgaaaagtacgatgcttgcggaaggaattttttcaaaagtgcctgatgcgggtgaggagaaacagctggaatcgctgcctgaacgtgtgcggcagacgcttcttgaggcaaagcaggccggcatcaaacatccgattgcggctggcgccattccgtttgacggaagaaaagcttcccggctttttgtaccgaaggatgtccatacggcaggcccgctttcgttttcagaagcttccgcagaaaaaccgcaatccaatacatatgacatccggcctgttccggagcctgagggcttcatgagcggtgtggaaaaaggcgttttaaacattacggacggaccgctcagcaagattgttctgtcaaggacgcttcatctgaccgctgaaaaggatatcgacatcccccaagccgtcaagcatttggcgcagcacaacccgcgcggctatacattcgctgcggatgtgacgggaacgtcagaaacaagaaaaacgcttttcggcgcaagtcctgaactgctgctgtcgaaaaacgggacatcaattttgtccaatccgctggctggttccagaccgcgcagcgcagatcccgccgaggaccagagaagagcggaggaactcctgcaatcagccaaagacctgcatgaacatgccgtagtcgttgccgccgttgccgctgctcttaaaccgttctgccgcgtgcttgatgtgccggaaaaaccgtcactcattaaaaccgaggcgatgtggcacctgtcaaccgaagtcaagggagaacttgctgatccgtcaacgacctcgcttgagctggccatcgctcttcatccgactcccgctgtatgcggaacgccgacggatgcggcgagagaagcgattcaggatattgagccgtttgaccgtaatttctacacgggaatggcaggctggtgtgatgctgaaggtgatggagagtggattattgcactccgctgcgccgaggcagaaacaaggtctctcaggctctttgcgggtgccgggattgtcgccggatcaaagccggaggatgaattggacgagacttcggcaaaattccgcacaatgctccgggcgatggggctatatcaagatgagatgtgaaaaaggaggatacggatcgtgctgacaggatttacgccatggccggaagaatgggctgacaaataccgcaaagacggctgctggaagggtgaaactttcggaggaattctgaaggagcgcgcggctttatatggaaatcaaactgccgtgacgtataaagatgtacattggacctacaaagaattagatgaaagggccgatcgtttagcggcgggactgcacaagctcgggattcaaaaggaagaccgtgttgtcgttcagctgccgaatatcgctgagttttttgaagtgatattcgccctgttccggctcggagcgctccccgttttcgcgttgccttctcatagaagcagtgagattacttatttttgcgagtttgcagaggcgaaagcatacatcattcctgatacgcattcaggctttgattacagagagcttgccagacaggtgaaagataaacttccggctttggcgcatgtcattgtagccggtgaggctgaagagtttctggaactgagcagcctgcacagagagcctgttcagctggaagacgtaagctcggcggaagtcgcttttttacagctttcaggaggcagtacggggctgtccaagctgattccgaggacacatgatgattacatatacagcttgcgcctcagcgcggaaatatgcggcttggatcatcacagcgtttatttagctgctttgccgacagcgcataattatccgctcagttcacccggtgtgctgggaactttatatgccgggggccgggttgttctgtcaccgacgccgagtccggatgactgcttcccgttaattgaaaaagaacgtgtcacgattacagcgctcgtcccgccgctcgccatggtatggatggaagcatccggatcgcgaagtgatgatttatcaagccttcaagtgctgcaggtgggaggcgccaaattcagcgctgaagcggcccgccgcgtgaagagcgctttcggatgcacccttcagcaggttttcggaatggcggaaggattagtgaattatacgagactggatgatcctgaggagattattatcaatacgcaaggcagaccgatgtcaccatttgatgaagtgagggttttaaacgatgacgggcgggatgcggctcccggcgaaaccggacatttgtttacacgcggtccttacacgattcgcggatattataaagcgcctgagcataatgcgagatctttcacagccgacggcttttatcaaaccggcgatatcgtcaaactgacggaagacgggtatattgtcgtcgaaggacgggcgaaagatcaaatcaatcggggaggcgaaaagattgccgctgaagaggtggaaaatcaccttctcgcccaccctgccgttcatgatgcggccatggtttcaatgccggatgattttctcggagagcggtcctgtgtgttcgtcattccgaaaggagaagcgccgaaaccgggagagctgaaagcatttttgcgtgagcgcggactggcggcctataaaattcccgaccggattgaatttaccgcttctttcccgaaaaccggcgtcggcaaggtcagcaaaaaggatcttcgcgaaacgatcgccaaaaaattgaagcctgctgaaatcaaacaatcataaaaaaggaagtgtttacattggctataccggctattcccgcatatgcgctgccgacagcgtcagatatgcctgaaaataaagtatcgtggactctgaacccgaaccgtgcggtgcttttaatccatgacatgcagaattatttcgtcgatgcttttacaaaaggggcggctccgatcacagaggcggctcagaatatcaaaaaaataaaagagcaatgcaaagcgctcggcattccggtggtgtacaccgcgcagcctggcagccaagacccggcggaccgtgcgctgctgacggatttttgggggccgggactcaaaagcgggccttatgaggaaaagatcattccggaacttgcccctgatgatcaggacattgtcctcacaaagtggagatacagcgcgtttaaacggacgaatctccttgacatcatgcgtgaaagcggcagggaccagctcatgattacgggaatttatgcacacatcggctgcctcgtcacagcctgtgaagcatttatggatgatatccaaagcttctttatcggagacgccgttgctgatttttcttcagaaaaacataagatggccatcgaatatgcgtcccagcgctgtgcttacacggctttgacaaacgaagtgctggagctcttggcaggctctgctgacggagaagagaagacttcagccgcattgacaaaagaacggatgagggagcaaattgcggcgattcttcaagaatcaccgtctgatattctggatcaggaagacctgctggatagaggccttgactctgttagaatcatgagccttgtcgaacaatggcgccgtgacggagctgaagtgacgtttgtggaactggcggagaatccgacgctggaagagtggtggagactgctttcttcccgatctcaaaaagtcttgccgaacgcagattatttataagggagagaatagaatgcatgaaacacaacagctgcctctgacaggcgcacaggccggtatctggtttgcgcagcagcttgatcctgataatccgatttacaatacaggcgagtacgttgagattaacggcacaattgatgtgaacatatttaaaatggctcttgagcgcgtgctgacggaagccgcgtcattacatgcccgcttcaccgagggaactgacgggccgagacagatcatcaatccttcttgtgaggcggcaatcgatgtcatggatgtgagcgcagaacctgatccgatgcaggccgctttcagaatcatgcagtcggatttggctgagcccgttgatatggcggctgggcctttgttccgcgacattttattccaagccgggccggaacgctttttctggtatcagcgcattcaccacattgcgatagacggctacggtttttcactgctggcacggcgtacggcgcaattatacaccgcgatacgggagggacgtccggataacgggcgctccttcggttctttggaggagctggtaaaagaagatcaagagtaccgagcgtctgatcaatttctgaaagatcgggaattttggatggagaaatttgcggatgaacctgatgtcgtcagcttggcagaaagagcgccgagaacgtcaaaaagttttcggaggagcacggcttatctttctgaaacggttttacagcatgtaaaagcgattccaaactggcacgaggccgtaacggccgcagtggcgatatacgtccaccggatgacaaacgccggggatatcgtgctcggtttaccgatgatgggacggatcggttcgatttcactgaatattccgagtatggcgatgaatcttctgcctttacggctttctctccgcccggatatgaatgttcacgagaccgtcagccaagtggcaaaagaaatccgaagcatccggcgccatcagaaataccgccatgaagacctgcgccgcgaccttaaattgttaggagaaaaccgcaggctgttcggcccgcaagtcaatgtgatgccgtttgattatgcgcttgatttcgccggagtgccgggcaccgttcataacttatcagcagggcccgttgatgatttgtcaatcaacgtttacgacagagcggacggccgcggattgcgtgtggactttgatgcgaatccggaagtctacagcgccgaagatatcgaaaaccatcaaaaacgcttcttgctgctgctggagtcggctctgaaagaccagacgcaaaaaatcggcagactcaatcttctgcttgaaaacgaacgtctccgcgtgctggaaagctggaatgacacgcgcaaggccgaaaagcagaaaagtctcccggagctgtttcatgatcaggttgtaaaaacacctcaccgcccggcaatcatcacggaaaacggagagctcagctatgccgaattgaataggcgagcgaaccagcttgcccgcatgttaaagaaaaaagggctcgggccggaacaatttgccgccttattgcttcctcggtcacaggaactggttgtgagcatgctggccgttttgaaaacaggagctgcgtacctgccgcttgatcctgattttccttctgagcggatcacatacatgctcaaagatgcacagcccgcctgtctgattacaacgatggaattatcgggccgtatgccggaggaaagcgatgcaaaaacgattattctcgatcacccggatacggtaaaaaccgttgctggtcaaaatgctgactgtcctgctcacacggaatattcacctcagcaccctgcttatatcatttatacctcgggctcaacgggcagaccgaaaggcgttgtcgtcacattaaaaagcgtaagcaatttcctcctatccatgcgggaaatgttcccgctcggcgcacaagaccgcctgcttgccgttacgactgctgcgtttgatatttccggacttgagctcttccttccgcttatcagcggggcgggctgcgtcattgcccgtaaagagacgattcaggaaccgcaggcgcttgcgcacatgattcactcatacggtatttcaatcatgcaggcaacgccgacactgtggcattcattggtcacaaatgaaccggattcactccgggcgctgcaggtgcttgtcggaggtgaagcgcttccgaatgcgcttatgcatgctctgcttgaattggactgtacggtgacgaatctgtacgggccgactgaaacaacaatctggtcggccgcacagccgcttgcaaaaggccataaaggggcgcctccgattggaaagccgatttggaacacgcgggtatacgtgctggacgccgcattgcagcccgtcccggcgggggttgcgggcgagctttatatcgcgggcgaaggacttgccagaggatattataaccggcctgatttaacagccgagaggttcattgccgatccgtacgggtcagcaggtgcgagaatgtacaggacgggagatcttgtgcgctggcgtgaggacggctctcttgattatatcagcagagccgatcatcaaattaaaattcgcggcttccggatagaattaggagagattgagacggtgctgtcaaactatccgggtattttgcaggccgctgtcattgtccgtgaagatcagccgggagacaagcggctggcggcttatgctgtcgcggatcatccccttgatatcagcgggcttcgtgcatttatgggcgaaagcctgccggattatatggtgccgggcgcatttgtacagctggaagaattgccgctgacaccgaataagaagctcgatcgcagcgctctgcctgcgccggatttttccgccgtcctgtctgacagagggccgcggacgccgcaggaagaaatattatgcgatctgtttgccgaggttctcgggctcgctcgggtcggaattgatgacggattctttgaactgggcggacattcactcttagccggacgcctgatgagccggattcgtgagacgatgggcgcagagctcggcattggccgcctgtttgatacaccgaccgttgccgggctcgccgcacagcttgacaccgcaaagagtgcgcgccctaagctcaagccgtttgaccggccggagcacatcccgctgtcatttgcgcagctgcgtttgtggttcctttactgccttgaaggtccgagcccgacttacaacattccggtgattgtccgcatgtcaggaaaccttaaccagtcagcgctgaaacacgccttttacgacgttgtcagccgtcatgaaagcctgcgcactgtttttccggaaaataagggatcatctcatcagctcattttacctgctgaagaagcccggcctgcgtttacagtgacacatgcagacaaaagtgagcttcaagacatgattgccgctgcagcacgctaccggtttgatttggcaaaagagccgtccgtccgggctgagctgtttgatcttggtgacggtgagtatacgctgatggttctcctgcatcacatcgcaggtgacggctggtccttgaatccgctcatgcgtgacttatccgcagcctataccgcccgtcaaacaggcgaaaaagcagaatggacaccgctgccgattcaatacgcggattatgcgctctggcagcagcagctattaggcagtgtgtctgattctgagagcttaatagcgcggcagcttgatttttggaagaaaacgcttgaacatgtgccagatcagctggagctgccgtctgattttccgcgtcccgccgaatcaagctacagaggcggcgtcattccggtcaaaatcggccgggagcttcacagccgtctcctctcgctagccagaaatcagcgcgtcagtctgtttatggtgcttcaatcagggctttcggcgctgctgacccggctcggggcaggaaccgatattccgatcggcagtccgattgccggccgcagtgatgacgcattgggcgatcttgtgggcatgttcatcaatacactggtactgagaaccgatacctcaggcgatccaagcttttgtgagctccttgaaagggtgcgggagatgaatctcgcggcatatgaaaatcaggacgtgccgtttgaacgtctcgtggaagaattgaatccgcttcgttcccgctcaagacatccgctgttccaagtgatgctcgcattccaaaatacgcctgaccctgtgctcagccttccagaaatggaaacaagcctgcaaatcagcagcgtcggagcgtccaagtttgatttgacacttgaattggctgaacagcgccatgacgacggcacgcctgccggtattgaaggcctgctggaattcagcacggacttatttaaaaaagaaacggctgaggcacttgcgggacgtctgcttcttctgctcgaagatgctgcggcggatccggataagccgatcggaagcttaaccattctttccgatgaagagcgcagaaagctgttgtcggttaaacggactgcacagcacattcagcctcagcagacactgcctgagctgtttgaaatacaggccgctgaaaaacctgatgaaacggcagcagtatttgaagagcgccgactcacttacaaagagctgaatcaaagggctaatcagcttgcgcatatgatgattgcccgcggcgtcggcccggagcagtttgtcgcgctggctctgcctcgctctttagatatgattgtcgggctgttagcagtcctgaagacgggagccgcgtatttgccgcttgatcctgattatccggcggaccgcatcgcttttatgttacatgatgccaagcccgtatatatgctcaccaaccgtgaaggcgcaagtaagctctctatcggaagcggtatgaccgccttcatcttagatgacccgcagaataaaaaaatacttgagcaatatgccgtcacgaaccctgcggatgccgaccgtatttgtcctctgtcgccgcttcacccggcctacgtcatttacacgtcgggatcgaccggtgtgccgaaaggtgttatcattccgcacagcaatgtcatccggctgtttgagtccacgcagcactggtatcacttcgattctgatgatgtatggacgatgtttcactcttacgcgttcgatttttctgtctgggaaatttgggggccgttgcttcacggaggacgtctcgtcgtcgtgccgcatgacaccagcaggtcgccggaagcgtttctgaatctcctcgtgaaagagcgagtgaccgtgcttaaccaaacgccgtcagcattttaccagctgatgcatgcggaaaaagaaaacaaagagctggggcgtcagctcgcactcagatatatcatcttcggcggcgaggcgcttgagctgagccggcttgaggactggtacagccgccacccggacaataagcccgtgctcgtgaatatgtacggcattacggaaacgacggtgcatgtcagttatcttgaattagataaaaacattgccgaactgaaggcaaacagcctcatcggctgcggtattcctgatctgaacgtatatgtgcttgatgatcggctggagcctgtgcctccgggcataacgggcgaaatgtatgttgccggagggggcgtggcccgcggttacttagggcggcaaagcctgaccgcggaacgctttgtggctgatccgtacggcccgccgggaacaaggatgtacagaacgggggacttagcccgtctgcggccggacggttcgcttgattatatgggcagggcggaccaccagattaaaatccgcggcttccggattgaactgggcgaaattgaagcggttctcgtcaaacatccgggtgtcgaggacgctgccgtggtcgtccgtgaagatcagccgggagataaacggctcgccgcttaccttgtccgatctgacaccagtaccttggatacgggggacatgcgccaatttgccggagaaagcctgccggattacatggtgccgtcggcttttgtccaaatggatgaactgccgctgacaccgaatggcaagcttgaccgaaaagcgctccctgcgcctgacttccaaatggaggtctccggccgggggccgagaaccccgcaggaagaaatactgtgtgaactgttcgcagaggtgcttcacctcccgcgtgtcggtattgatgacaggttctttgatttaggcggccattctttacttgcggttcatttaatgagccgtattcgggaagcgatgggagctgagctgagtatcggaacattattcgaagctcctactgtggcaagccttgctgaaaggcttgagacgggcacgggcacaagcgcgcttgatgtcctgcttccgctcagaacggcgggagaagaaacaccgctcttctgtgtccatccggccggggggctcagctggtgttatgccgggctgatgtcttctttagaagctgattatccgatatacggcttacaggcgagaggcattgggaaaaaagaaccgcttccgcaaagcttagatgacatggcggcggattatattgaaaaaatccgcaccgtgcagccgaaagggccgtaccgtctgctgggctggtcactcggaggaaatgtcattcaggccatggcgacacaattacagagccggggcgaagaggtttccctcttggtgatgcttgacgcgtacccgaatcattttcttccgataaaaaatgcgccagatgacgaggaagccgtcattgccctgcttgcccttggagggtacgacccggacagcctcggggatcagccgcttgattttgataccgcgctgaccattctccgccgtgagggaagcgcattagccagcctggacgagtcagtgatgatgaatttgaaagacacatacgttaattctgtcggtctgttaggaacatacaagccgaagccgttccacggagatgttctgttcttcagatccacgattattcccgagtggtttgacccgattgaaccagatacttggaaaccatatattacggggaaaatcgagcggtatgacttagactgccgccataaagatatgtgccagccgggcccgcttgccgaaatcggcgcgattctggcggagaaattaaacggacggcgtacagtccggtaaagaaaggaatgagctgatatgacaaatccatttgaacgggaagacggcttatatcatgtgctcgtcaatgctgaaggccagtactcgctgtggccggcctatctggatgtgccggacgggtgggaaacccgcctgacgaatgaaaaccgttccgtttgtctcgaatatattgaaacaaactggcgtgacatgaggcctgaaagcctgaaacgggctgaacctgctaagatgtaataaaaaaagcctgccgttgattcggcaggctttttatgcggaaatcagctgttaagctgtgtatgatcacaaaatttataagggtggccttcttcattcgtgcaccatgactgagacagaaaagccaaaaagaccgcggcccactggtctgcaaactggattaaaataccgccatcatgccacgtcccgttatccttcttccagcgtgtatcaattggatttccctgattcatatgaatattatgcatgccgtttgtcggtttgaacccgaaaatcttatcagcgtcctgctccggcccgaatttagagccgtaaatatagacggtggctttttctgtttttgctttttgcatatacgtttcaataaaatcatttaagtcattatctggcccggtgacttcatgcgggagcgacaccatgttccggggatcaaacaaattgccgcggacataatccagcgccagctcacggcttttgtcatcaattggtgtgtatccatacggtatgttcggcagcagggtgatcgcgcttgcgtcaaaatgatcgcgcgccgcatacagaacctctgattcttttgaacttgacatgacattgatcgcacagcgatagtgcgtatcaggctcgcctagcacctcgacttgaaaatgcggagaatcatcatctgtttcccttctcatatctaacacagtgccttttaatacaccatagtgctgaacagccatatgaatcctcctttttcttccgggatatgaattgatattcgagacagggggccgtttttccttttacgagaaagaaaaaaaggacagcctgctgatcaggccgtcctcttcatatctattaagcttttgcaactgaaccttgcatcgctttttcagcaggcacgtagtcatagcctaagtctttggctaccgcttcatacgtgacgtgtccgttagccgtattcaggccggctttaagcgccgggctgtctgtaatggcttttgccgcgcctttattggcgatttcaagcgcgtaaggaacggtcacattcgttaatgcgagcgtagatgtacgcggtacggcgccaggcatattagcgacagcataatgaacgacgccgtgtttttcataagtcggattatcgtgtgttgtaatatgatcaacggtttccacaatgccgccctgatcgatggcaacatcaacaatgacggaacccggtttcatttgtttaaccatttcttccgtaacgagagtcggcgctttggctcccgggatgagcacggcgcagatcagaagatccgcttccgcgacggagtctgcaatatttacagggtttgagatcaatgttttaatctgatgcccgaaaatatcatcaagctgacgcaggcggtctgcgttcaagtcgatcatcgtcacatcggcaccgagtccgacagccattttcgcggcatttgttccgacgccgccgcctccgatgatcgtgacttttccgcgggatacaccaggtacgccggctaataaaattccttttccgccctttggtttttcaaggaactgagctccgatttgagcggccattctgccggccacttcagacatcggcgtaagcagcggaagtgaacgtccgtccgttaccgtttcgtatgcaatagctgtcacgcctttttctgtaagcgctttagctaattccggctctgcggctaaatgaaggtaagtgaataagatcaggccttgacggaaatacgcatattcctcagccagcggttcttttaccttcatgaccatttctgcatcccatacttgctttctgtcttcaagaatttccgcgcctgcggatacataatcttcatttgtaaagccgcttccgagtcctgctccggattccacaagaacccgatggccgtttccgataagctgtgaaacgcctccaggtgttaatgccactcgattttcattgtttttgatttcctttggaaccccgataatcatgtctgtttcccccaatgtttgtgtgatgcttcaagtgtagcgcgattgttgcgaaaattctttgtttgaaacagaaaataaaaaaacacggatttgtgaaatttcacgaatccatactgcgaagcttgatatcgaggtaaatcgtaaacttttcattcacattttttaagtcgatttctgcgatctggctgattcttttcagcctgtaattcaatgtattgacatggatgttaagcgctttagcggcggtgttgacattgctgtcggcatcgataaaatgttcgagcgttttgaccatatcggcctgatgctctctgtcatactgctcaagctttgacagggaatagttcatatagccgctgtgcttgcgtttttcatccaaaacatcaaggtactgataaatcccgagttcagaaaagctgaaaaggtgtttggtttctctcacaaaccgctctttcgctttcaatacggagagcgcttcctgataggagcggtaaacgtaagaaatcgattcgtaaataccgccgaaagcaatcgacgcatcctcaattttatatcgttctttcagctgtttttgaacatggagggcgaactgttttaaatctttaaaaggctgatcggatttcggcgcggctaataagattaattcattcgaatcgacagtcgccagcatgacatgaatctgctgtgtcgtttcctgcaaatattgcagctgctgttccgtcttttcagtcagctcatcatgtaaacggatgatcatgacgctgaacacggacggcagcgccattccgagcttatgaaacccttcggccatctcggcttcctgataaatatggccggtcagcattttccaaaaaaactcctggccccgctcttcgatttttgttttgcggatctgcaggtgcaaaagcttgttccgcaccgctttggcggccagctgaagcgtcttcaggtcctcatcattgagcttttttttgatctcaagcgcccatataaatccgagaacctggctgtttttccaaatggaaatcgccacgcggttgctcaggcccacctcgtcgatttctttcactttgatcggctggtctgtttttaaaagcgccggaatggttccgtctttccacagtttgttgatgactttttcaggcaccctccgtccgataatcgtcgacgtccgggccggatctgtacaatcgctgtgcgtgctgtatgcaagcagtttatgattcacgtcttctattgtaatggggcattgaagaacttcactgatatggtcggcaacatcttcaagcctgtcgaaactgtacttaaatggatcttttggattggtcatctgtatccctactttttcatagcttcatatcttgatcttaccatcttgcttttcagactgaaaggcatctttgaacggaaataaaataggaaaatcagatcatttgacgaaatcaaaaagaataagaaaatcataccattatatttacaaaatgtgtaaatgtgacgaaaaatcctgtatatcataagactcattttgtaaaattaaaacagatttgtttgactgtgccgaattgttgtttttataataatgacgttcaaaaaataagtgaattagcccatatttaggctgatgacacaggagggtataaggaatatgtctggattaattcgtgtcacacccgaagagctaagagcgatggctaagcaatatggcgttgaaagtcaggaagtcatgaatcaggttgaccgcctgaaccgcatgatttctgatttgaaaggcatgtgggacggtgcttcaagtgaagcatttgcggatcagtatgagcagctgaaaccttcatttattaaaatgtctgaattgctgcaagatgtgaatcatcagctcgaacaaacggcaaatacgcttgagtctactgaccaagatatcgctaaccaaattcgcggataataagatgaatgaagaaacggagcgcctgattcaatcaagaagacggcgctctttctatgtaagggtgatatgaaaatgtatatcgatattacaatagatttaacacattataacggcagcgtcttcgatctcagattgtcagattaccattctgtgaaaaaagtcatcgatattgcccggcaggctcagcatgtatccgttccgccgcgtgaaggctattggatcagagtggtcaataaagaaacggttttttccggagaacaaaaattatctgactgcggcattacgaacggagaccgtcttgaaattttatgagaggacatggtggaatgacagatcataacagatcttatttagaaactgaattagacgccgtccgggcagaaaccgaatcaggcttcaccttcacctttcagcgggaaaaagtcaagcttcttgacgggctggaagcaaacgtgattaaagatgctgatcctttttttcaaaaagaggtttcagtctcagaagacgaagtaaccataacaatcagacccccttcttcttatcaggctttccgctatataaaaggaaaagataaaaaaagcagatggcaatttgcctaccgtctcgtgcaagctgtgaaacagcacaagctgaaacgcctcaatctgattgccgcgccggaaaatatcgtatttgataaagcgctgacgccttactttcttcattacggcgtaaaggagagtctcccgccttatgaagaagacagacaaagggtgtggaaagagctcaaagcctgtgcggcgcttgcagctgacggggcgtacaccttcgaagaatatctgaagtacaaggagacgcttcaattctctcctgaggtgaaaagcgtgttagaggctgagacgtttgaagaactggaagaaaccattcaaaccacaattgattccctcgaagcaagggacaagacatacataaaactgccgaaaaagaaatggaaaatccaaagatacgtcggtctggcgcttgcagttcttcttgtgccggcacttctgtattccttgtacgtgctgtttttcgcccagccgaagcaagaggcaattacggaaagcaaccgctattttctcaatcagcagtacagcaaagtcattgacacgcttgctaaatacaacgcggaaagcctccctgaatctgtgcagtacgagcttgcttcctcttatgtggcagttgaaaatctgagcgaagaacagcggaaaaacattgggaatctggtcacgctgcaatcagatccgaagcacttcctttattggatcgatatcggcagaggggaaaatgaagaagccatcaatatcggccgcaatcttgagtacaacccgtatatctggctcgggcttacaaaatataaacagcaattattagcggacgacagtatgaaagacgatgaaaagcagaaagaactggacgccgtggaaagcgagctggcgaaggcgaaaaaagagcaggaagagcagaacaaagaagcggaggaaaaccgtgacaccgtcgaagcttccgccggacaggataaagatggcaaaaaggacgaagcgaaggataacaaagagaacgacaagaaagatgagaaaaaagatgaaaaaaaataacagcacacatcaaatggccgtaagtaacgatcaggctgtcaggaggttcgccatatgagtctgttatgggtcttttaccgagagcacgtacaaaagattcagctgtctgaactcccgccgtctcagccgatcacgatcggcccggatataaaggatacgatcacgatcggcacactgcctttacggcaaaccgccgccaccctttatcgtaaagaaacagaccgttatgatgttttcctgggaaataactgtgccggcgaattgacaataggaaatgaaatgccttgcagaatggaagaagagacgatgcggcttcttctcactcctgatcaggaagaatcctccgtttattttgtcggcggaaaggacgagatcgttttctcatcagaaacagaggaagcggatatatacaaagagccgtcgtccgctcaaaaaggcgctttttatctccgaaaagcgggaggaagctggtctgtcattcctgatggtcaggaagtttatgtaaacggagagctcacaaaagtccctgaaaggcttcggatgggagatgagctgctgtggaattttctgcgtctgaggctgacggaggacgaccttttagaagtcgttcatcacgaggagtttcaaaccggcttaattaaaacgataaagccaagcactgaaatgaaaaagaaatacccgcaatatcgaagaacgccgcggatggtctacgatcttcccgaagaccgcgtttcattcagctttccctcacaggaaagcgagcagaataacagggggctctggctcgtcattctgcctcctgtggtcatgctgattgtaatgggggttgtcgccattatacagccgaggggcattttcattctcgtttctttagcgatgtttatgatgactctcattacgtccaccgtgcaatatttccgagaaaaaaaccagcggaaaaaacgggaggagaagcgtgagcgtgtgtacaagcagtatttagagagtaaacggaaagaacttcagacgctgtcggaaaaacaattgcaagtgctgacgcaccattttcccacgtttgaaaaaatgaaatatttaacctctgaaatcagcggccgcatttgggagaaatcgctggaaagcagggattttctgatgctccggctcggaacgggcactgtcccggcaagctacgagatctcgatgagcggaggggacctggcgaaccgtgatgtggatgacttaatggaacagtcgcagcacatgcagcgtgtatataaagatatccgccatgcacccgtgaccgttgatttacaagaagggccgatggggcttgtcgggaaaccccagatcgtcaaaaatgaaattcaccagctgatcggccagctcgctttcttcaacagctaccatgacctgcggtttgtctttatctttcatgaagatgaatataaggaatgggaatggatgaagtggctgccgcaatttcagctgcctcatatgtatgcgaaagggtttatttacaatgaacagacccgtgatcaattgttatcttccatttacgagctgctgcgggagcgggatttggaagaagataaagagaaaaagatcttccagccgcattttgtctttgtcatcacgaatcagcagctgatcgcagagcacgtcattttagaatatatcgaaggccggcatgagcatctcggcatctcagcgatcatcgccgcggaaacgaaggaaagcctggcagaaaacattcacaccctcgtccgctacattaatgaagatgaaggagacatcctcattcagaagaaaaaagcggtccagatcccgtttaggctggacaggcatgaacggacaaacaacgagcggttttcccgaacgcttcggacattgcaccatcaggtcgggatgacgaattccattcccgaaacggtctcatttttggagctgtttcatgcgaaggaagtaaaagaaatcggcatcaggcagaagtgggagacaagtgagtcggcaaaatcactggctgttccgatcggctacaaaggtaaagacgatatcgtgtatttaaacctgcatgagaaagcccacgggccgcacggattgctggcgggaacgaccggctccgggaaaagtgaatttctgcaaacgtttatcctgtcattggccgttcattttcaccctcatgaagcggcgtttttgctgattgactataagggcgggggaatggcgcagccgtttcgcaaaatgccgcaccttctcggaaccattacgaatatcgaaggaagcaaaaacttcagtatcagggcgcttgcctctataaaaagcgagctgaaaaaacggcagcggctgtttgatcaatatcgcgtcaatcacattaatgactatacaaagctgtataaacagggggaaacggatattccgatgccgcacctgtttttgatttcagatgaatttgccgagctcaaaagcgaagagcctgactttatcagggagcttgtcagcgcggcacgcatcgggcggagccttggtgtgcatttaatccttgccacgcaaaaaccgggaggcatcattgacgaccagatatggagcaactcacgctttaaggtcgcgctgaaagtccaggatgcaagtgacagtaaagaaattctgaaaaacagtgatgcggcgaatattacagtcaccggacgcggctatttgcaagtcggaaataatgaagtgtatgagcagttccagtctgcctggagcggcgccccttacatggaagatgtatacggcaccgaggatgacattgccatcgttaccgataccggcttaattccgctgtctgaagtggatgcggacgacttggcgaaaaaagacgccccggcagaaatagaagccgtagtagaagaaatcgagcggattcaaaaagaaatgggcattgaaaagctgccgagcccgtggcttccgccgcttgccgaacgtattccgcgcacgctttatccggcgaaggaaaaagaccgcttcttcatcgcctgcgttgatgagcctgatcagcaaagacaggcgcctctcgcctatacgatgatggatgacggcaacatcggcattttcggctcatccggatacggcaagtcagtggctgccatcactctcctgatgaacttcgcggaagggtacacgccaaaagagcttcatatgtacatctttgacttcggaaacggcacgcttctgccattggcaaagcttccgcacaccgcagactatttcttaatggatcaaatgagaaagatcgaaaaattcatgatccgcatcaaggaagaaatcgagcggcggaaacggctgttcagagaaaaagaagtcagccatatcaaaatgtacaattcgctcagcgaagaagagctgccgtttatatttatcacaattgacaatttcgacatcgtaaaagacgaaatgcatgaattggaaacggaatttatccagatttcacgcgacgggcaaagcttaggcatttacttcctgctgaccgcaacgagggtaaacgccgtccgtcagtcattgttaaataatataaaaacgaaaatcgtccattatttaatggatcagtcagaaggttattccatttacgggcgtccgccgttcagtctcgaaccgattccgggacgcgtcatgattcaaaaagaagaactgcatttcgcgcaaatgtttcttccggctgaagcggaaaatgacctcgagatgttccaagcgctgaaagccgatgtcaaagctttagctgagcgccatgccggaacagccggtccaaacccgattccgatgctcccggacatgctgacggccggcgaattttcgctccgtctcggcccggatcaagaaccgttccgcattcctgtcgggcttcatgaggaaaaggtcagcccggtatactttgatctgggcaaatataagcattgcctcatcttaggccagacacagcggggaaaaacaaacatcctgaaagtcatgctgaatcacctgctgcgtgaaagcacggaacggatcggactgtttgactcgattgaccgcggattgtcgcagtatgcgcaggaaacaaaggtcagctatctggacacaaaagaagacatacagaagtggattgaagcggctgaagccattttcacggagcgggaagctcagtatgcacaggccgtcaaaaatggcgatgtgcacaaactcaatttctctccgatcgtgttaatggccgacggcattacaagattccagcagacaatcgacaccgccattcaggacaagctggcgatgtttatgaaatcttacgcgcatgtaggcttcagttttatcccggcgggcaatcacagcgaattttcaaaaggctatgattccttaacgacggaaatgaaacagatccgccacgcgatgctgcttgtgaaaaaatctgaacaaaatgtcattccgctgccttaccagagacaggaaccggacattcagccgggcttcggctatttggttgaaaacggcaaggagcaaaaaatccaaatacctttatgttcagcggaaagggaggccgtcagatgactgaacaacgaaaaagcctgatcaaattagtagccgcgatcgtcattattctgctgctgccggtgctgtttttccggtttatcggcgatgacccgggaaaacaaaaaatcaatgccacccgccaaatcgcagtcgtgaatgaagacatgggcttacatgatgaaacagatgaaaatgaggatagggaatcggtccatttcggcaaagaagtagcggcggctctcggcgaccgtccggattattcctggacggtcgtcaacaggagcgcggctgaaaacggcctggcggataagaagtatgacgcagtcgtttacattccatccgatttttcaaaagacattttaagctatgacaaggagcgtccgcaaaaagctacgctgacattcaatattcaaagcaacctgaacgccgtcaacaaagaaaaagtgcagcgtgagcttgaagacgcccaaaaatcaatgaataaaaaaatgtcggcattgtattggaatttcgtctcacaaaaagtgaacaatgtcagaggcgattttgacaagatcgtcaataaagaatcagaatttcaaaatgtcatgtacaacttttacaagccgagctccaatgacttggcaggtgagatcaaacggcaaaaagacctgattgacgaactgaaaaaatcaatgaacgaagcgcagggcgcagcaaaagaaaaattgacctcggcagatgaagccaaaaacacgctcaaagactttgccgatacagttgagcgctataaacaatatcaggaaaatcagaaaaaactgctgctggccgcgcaggaacaaaatcaaaagcaaatcacaaccggactgaacgctattaaagcgcagcaggccgccaaccagttcagcaccatgatgagcgggctgtcttcaggcataaaccgggcgcagacacagcttgaccagacaggatcggcactggcagccgcccaaaaggtgagagaagcgcaggtccctgagcaggaacaagggatggcaaatattcaatccaatttacttgacaattatttgactcaatataaagcccaagcaagatttgaaacactgaacagcattcaagcccttatgaaaagggatcgccagaacttaaccgttccggaaaaagacccgggggatgacggctcggatgaaccgaaagaagaagaaaaaccggaagaagaaaaacccggtgatctgaaaattgaccttgacgatcagcgtaacgaattaaaacgcatctccgctgagatcaattctatttctgacggtttaaaagaaccggaaaaagaaaatccagaccctgaaaacccgggccatggggataatggtgaaaactccggcggtaccgaaccgaatgacgggacggctcccggagaagacggaaaaacggatgacggcacaaaagaacagcagtctccttccgataacacaggcgatcagcagacaaaaacagccgcaaccgctaaaaacgtcactccgcttgctgatgaccccgcggacgatccgaacggctctgaaggagacggcggcacagaagtatctaaggcaaaagaaaggctgaaccaagccgcagagcgcattcagcaaattgaaaaagagcttgaagagaaacagcagacacataatgaagaactgaaaaaacgtctcgatgctcttgatgaagaaatccaaggccttaaagaccagattgccaaagttgaaaaacgtgcggacaaattacaaaaaaagctggaacaatcagaagaaacgagaaaacaagacttcaataccgtttacagaatgattttaaaaacagaacagaacattttgaactacccgtcattggacggcggccgcaaatctgctcttgaacagatatttgccgctgacatcaatacaaaagtgatatccgatttaatgagttactataatgatttatctttgtatgaggcaacactttatcattctctcgacgcaggctcgctgcctgatgtgaaaaacagggtgctgaaagcccagcaaggcgaagtccaaaccgttctcgccatcaaaccgattgaaacggcaagctgggaaaacctgaaaaacaataagatgcagacagatgaagacatcagcaatttcattaaaggcatgaccgaattctcggataactacagctcatatatcagagatgaacaagccggagtgctcgatgagctcgccagcatcgcagacagcgcggctaaagcatctgatcagcttgctgaaggcgctgtgcaggaagcggcaacgttcagcggagacggattaaccggaacgatggcgctcggcgctcaggataccgtcggccgcgaagtgctgcaaatgtctgacacgatgggccatctgtcagaacgccagtccggcatcatcagctataccgacaatatgcagcaaagcgtaaatgacgtacagcagaaagcggacaccctgaacagcaattggggcaaaaacgtcgattccacaaaattgatcagaaatgacgtgtacggcattttagggaacgcgctcgttgacggacaggaaaacggatacgtttacgattatctcgccaacccgcttaaaatcagcggagaggtgccggaagaccgggttcagaatgttccgccggtcgtcattttggtgatcgttttgatcagcagtcttctgatcggctatttcagctcgtattatcagcaggcgccgcttctcgtcaaaggcgcgctctttgggattttaaacattatggtcggactgatgatcagtctgttcggtctgaatatctactcgcttccggacgatcagacgattaaatggtcaatctttacgattctcttgctcgcggcgagttcggcttttatccgggcagcctttgtctttggctcgatcaccggatggatcgcttcgtcagcgctcattctcttttatgtggcgcctttgatcgacttgattatgccgaactttacctttgacagcccggtttcgaaagtctatatcgatatccaatacggtacgggccatctgtttgcgatgggaataacggttcttgtgattattacgctgattgcggcggtgcttccgctcattattcggctgtttgcggaaaaaacggaggaaagtgatcagtcttatgaggcgtaacacattcatggaaaaagggatcttgctgtttgctctctcctttttccttttccttcctcaagccgcagccgcgaatgaggacaatactgatgtcaagccgaatgaatatgaaaagaaagacattgaaattcgtacggattacctgcacgacgacgcctactccgaagaaaaaacggcgcttccgaaagagcagaaggacattacgtttgatcaaccggccgaaagcccggatgaaaaactgatatcaaatttgtttacatcgtcagacactgagccgaatacgatcaaagcgcaatcgaaaaaactggggatcacttttgccgagccggcggtgcgccatacctcggcagatatggaagcggatgagaaaaagacttcttttcttttgcctgtcatttatgccgtcctgatcctcttcggcattgcggcgatgatttatctgattccgaaagtcacggcgcaggaaaaggcaaagcggtaaacagatcgcttgtgtttgcgggaagacagtccgtaaaataagaaaaaaaaggaggagtgtcatgcagttttttctgataacaggcgcatcaaaaggattggggcgggcgcttgcggaacaggcgcttcaagaaggagccgaagtcgccgcgctttcaagaacgataagcggagaaaagcgcgagggactgacagaatacagtgttgatttaaccgatctgtcagacaccgagcggcagatgaaggcgattcttgatcaagctgatgagaagcggtattccgccgtcacactgatcaataatgccggaatggtagaaccgatcaagcgggcgaaagaagcttccgcagaagaattgaaccgccattacacccttaatctgacggcgcctgttttgctcagccaaatgttcacgaagcgtttcgaagcgttcaccggcagcaaaaccattgtcaacatcacatcgggcgcggcgaaaaatccttataaaggctggagcgcgtattgcagctcaaaagctgggcttgatatgtttacgagaacattcgggtttgaacaggaagatgaagagctgccggtccgcatgttgtcattctcaccgggagtgatggatacagacatgcaggccgtcattcgttcttcatccaaagaagattttcacgacatcgatcggttccgcaatctgaaagaaacgaacagcctcagaagtccggaatacatcgctggtgtcatccgctcactgatcgcaggagagccggaaaacggacggatatacgatatcaaagagtttttgtagagcagcttccgcgctgctcttttttatttgtacaatcacttcgcggcccggcggcatattatgactgaaacgcaatataaggggtataataatgtatcggatgaattgagtttcttctcgatttatgttaggattctaaaaatataaataaggaggggtttccatgagaaatgtaacgttaatggatgtcttcacccatccaatcgcacaaaagtatttacagcgttccggcgtcgcccatgcggttgcctgcgcgtttcatgcataccgtcttgccgtaaaagcaggtgtcagcccggatcttgcggcgaaagcggctttactgcatgacatcggccattacgaatggtacacagacggcaaatgggattatgaaaagtacagaagaaacgatatccatgccattaaaggcgctgaacgggcgcataagctgctcatccggctcggtgaagaaccgaaagcggcgaaagagattgcgctggcgattctgcttcacaccgattcctatctgcctgaaggcgaactggacaagaatacgctccagcaaattgtgaaacaagcggatgaactcgatgaagaacccggcggacatcaccattaccgccaaatggaccatacggccgcgctcaaacaaatccaaaagcttgatcagttaattgaccaagcccaatatcccataagaagctcagtctaggccactcatgcggccttttccgcttacataactccgcatgctcactaacccttttcccctccgatagacgtactgtgtcaaagcctttgtccgctgcatatgctgaaggaaaacatagtaaaggggatcagcgaaaatggcccatcaaggaagcccgcaaatcgtctcgttagtagatccttacgtttatcagaccatccataagcttatcggctcaaggtttatcattcaaaccgtcagacgcattgtcaggggacggctgattgatgccactccagatcatatcgccattgaagaaacgcatgaccgcgtattttatatcagaaaccgccatgtggtttctgtcatgcctgattataccgaacgtgtgtaacagcccgataaggcgcaaaccggaggccgtccttacaaaaccccggtgcgtcttcttttttgagatacatagatgcacggcggctttttttggtacaatcacagtacaagttcacataacaataggaggaaaccgcttgttgaaatcaaaggtccatttttggacgctgcaaattttgctcgttttgctcataatttacgtatcaacgaaagtctcgtttatttttcagccgtttttcggttttatcaccactctgttttttccgattctgatctcgggcattttgtttttcatttttaatccgatcgtgcgcctgcttgagaaaaaaatcccccggacattggcgatcctgctcatttatctcgttttcatcggcctgatagcctttatgttcaccgcaatcggaccgattgtggcttcccaggtcacggggctgtttaacaatttccctgattacattaatcagattcaaagcttgacgacacaattatcccattccaaatggtttacgtggatgatgacgcaggattatgtgtcgatagaaaaaattcagcagtctctgacgggatttttacaaagtcttccgcaaaatattaccgcaagcctgtccgccgtgttcggcgtcgttacgaatataacgcttgtcgtgatcaccgttccgttcatcttgttttatatgctgaaggacggccggcgttttccgctcttggcggtcaaaatcctgccttcttcctaccgggcggaaggtcggaaaatattcaatgacttatatgtcacattggccgcatatttccaaggccagctgctgatctgtctctttgtcgggacggcatgctttatcggatattggattatcggcctgccttacgcgttaattctcgggatggtgattgccgtcaccaatatcattccgtacctcggaccgtttctcggggctgcgccggcggtaattatcgcgtttatggattctccggctaaggcgctgtttgccgttattgttgtcgttgtcgtccagcagcttgacggaaacctgctttctccgcttgttatcgggaaacggctcaatacccacccgctcaccattattcttctgcttgtcggagcgggcagtttcggcggcattctcgcaatgattctggctgtgccggtttacgcggtcttaaaagcattcgtcttaaatatcgtccgccttatcaaacttcgtcagcggtcaaaacacgaagacaaccgcaagccgaaataaaaacgggcacaactccgcacgcgccgcataaaatgctgtaaagaaaagcggaggtgtgggtatgcctgcaattgtgggaccgatttatattatgagcttagccggagacgctgcggcgagcttcggtgacgtgtttgccatttctcccaaagccgttgaccactcaggcgcgggggcaggggcgtttcattccggagattttgtcaaagtcactaataaattcagcaaaacgctctttgaagatatcgatctgtttgacgaacctgattggtttaacgcgtgacagcctccctttaggaggctgtcgcttttttgtagtataatagaatcagtctttataaaaggggaatttttatgaaaatcagaaaagcgaatattaccgtgcagtccggaatgatcggcgatgtgtatctgcatgaaaataaaaaagaacagcataccctcgtagccgttccggaacttgagtggagcacgattatttcctatgaggaagagaaaaaggcgctggcgcagcggcttttacaatcattcagcaaactgattgatgaagagcctgccggagagctcgccggcaagatctcccattgggtcgctgaaatgtaacgaaacggtttaccgcgtccatgccggggcgataattgtaaaacaagctgaggagggacaggccgatgagcgacaaaacagttgacctttatttacagcagggtatgtatggccctctgcagacgaaaccggatgaacgccatttatttttaggctcgctgcgtgaaagagtcatcattgccctgacgaaggggcaggtgctgcaaaagaagccgtatgaagaagtgaaacaggcgctgaaaaaccgaaaagacgcggtgctgtatataaacggaaggctgccgtatcatgcttattcaccatatatgaagcttgccgcactggacggtgtccgaagctcagtgatctcggaccttcaatttgaaacgccgctcggcctggtttttgccgccgatcatgctgtgaacctggacggcatttatgttcaggatgacatttttcagcgttcactcctgaaataaatgtcattttacaatgccaattcacttacaggtggagataggatataatggttttcatatgaatggcggggaggccggctatgaaaaaagcatttatatgcattgattatacgaatgattttgcagcagagaacggagcattgacgtgcggagaacccgcaaggcaaattgaagatacgattgtcagtttgacgcaagcttttatagaaaacggtgattacgttgtttttgcggtggattcacatgatgcagacgatgactttcatcccgaaatacgcctgtttcctccgcataatatcaacggcacggagggcaaggagctgtacggaaagctttcgcctctttatgagaaacataaaaacgcaaaaaacgtaagctatatggaaaaaacgagatattctgcttttgcgggaacggatttagagctgaaactgcgggaacggcagatcactgaactgcatcttgcgggcctgtgcaccgacatctgtgttcttcacacggcggttgacgcctacaacaagggctttcagatcgtcattcatcaaaacgctgtggcaagctttaatcctgaagggcatgaatgggccctgtcccattttaagaacagcatcggagcgcaagtggcagagtaaggaaggggaaaataattttggtggagcatggttttaaagacgacagtttgtctttacatacagatctttatcaaattaatatggccgaaacgtactggagagacggcattcatgagaaaaaagcgatctttgagctttttttcagaaagcttccctttgaaaacggctatgcggtatttgcgggcttagaaaaagcaatcgaatacttggagaacttcaaatttaccgacagcgatctgaattatttaaaaacggaattgcactatgatgatgatttcattgagtatttacgggatctttcttttaccgggtctctttacagcatgaaagaaggagagctcgtttttaacaacgaaccgattatgcgggtcgaagcgcccctcattgaagcgcagctgattgagacggctctgcttaacattgtgaattaccaaacattaatcgcgacaaaagcagcccgcattaaaggcgttgtcggtgatgaggacgcccttgaattcggcacgcggcgcgcccatgaaatggatgcggctatgtggggagcgagagcggccctgatcggcggcttcagcgcgacgagtaatgtaagagccggaaagcgctttaatatcccggtatccggcacgcacgcccatgcgctcgtgcaagcgtaccgtgatgaatatacggcttttaagaaatatgcggagacgcacagagattgcgtgtttctcgtagatacgtacgatacgatccgttcaggcatgccgaatgcgattaaagtcgcgaaggaattcggcgaccggatcaacttcatcggcatccgcctggacagcggggacttggcgtacctgtcaaaaaaagcgcgtgaaatgcttgatgaagcgggtttcaaagacgcaaaggttatcgcttcaagcgaccttgatgagcatacgatcttaaatctgaaatcgcagggagcgaaaatcgatacgtggggaatcggcacaaaactgattaccgcatacgatcagccggccctcggcgcggtttacaagcttgtggccattgaagaggacggcaaactgaccgatactatcaaaatttcgtcaaaccctgaaaaagtgacaacgccgggaagaaagaaagtataccggattatcaacaagctgaatcatcactctgaaggggattatatcgctctttatgacgagcgggtaaacgaccagaaacgcttaaaaatgttccatcccgttcatacattcgtcagtaaattcgtcactgatttctatgcgaaagacctgcatgagccgatttttgaaaacggcgttttatgttatgataatccagaaattaccgatatccagcaatatgtccaggaaaacctcaaacttctgtgggaggaatacaaacggatcagcaagccggaagaatatccggtcgatttaagtgaagactgctggagcaacaaaatgcagcggattcatgagatcaaaagcaagctgaaacgggagcttgaatagatgataaaacggcctttcctttctctggaaaggctttttgtttgtgataatatttttcacatttagacaaatttcgtcaagttatttgatatacttatgttcgaaggccgcacctaagggggtaaatgaatgaaggtgtttgttgcgagacagcctatcttcaacagaaacgaacaggttgttgcttatgaacttctttaccgggagagtgaagagaaccgttattcggccgcggacggagataaagctactacagatctcattataaacagctttatcaacatcgggatcgaaaagctgacagaggggaaacgctgctttgtgaattttacagaaagcctgatgttttcagatctccctacctcctttgatcctgaccagctcattatcgaaattcttgaagacataccgatcactccggcactgatctcaagatgcagacagctgaagaaattaggatatacattagcacttgatgatttttacgccatcaatccggcaaatgaagaattattggaacagctgatgaaatatattgatattttaaaaatcgatttcctgcaatcttcgcgtctggaacgcaaaaaaatcattcagacgtacagctgtaaaaatctgatttatttagcggagaaagtggagacaagaaaagattataaacaggcagccatagacggctttcacctgtttcaaggatattttttcagtgaaccgcgtgtcatcagcggaaatgatctgacgtttcattttcattcttactaccagcttttaaacgaattaaaccaagaccagcccaatatagagcgcgtaacggaatacatagagcgggacgttacattatcgtatcagattctgcgttttttaaacggatcgcaaacaaggctgaaaaaaaagatagacagcatccagcaggccatcatgatgcttgggctgaatgagattaagcgtttgatttacattctttcattcagagatttaacggcgaaaagccactcaagccaaaaagaaatcattaagatttctttaatcagggccaagctgtgcgaactgctggcgaaaagaaccggaagaccgcagccttcctcttacatgctgatcggcatgttttcactcatcgatacgcttctccagagagagcttgaggacatagtcaaagaactgcctttaattgatgaagtcggacaggcgctgctcggttatgaaaacgattattacatgatgctcgggctcgtcaaagccattgaatgcaacaactgggactgtgacgagtggggaaaagaactggacaaagaagaagcatatgaatgttacttacaggcgatcgaatggtgccggcagcttatcgtgaattgaggcgctttaagccgaccacctgagggcgatgatgaaccggctttgctctctgaacagactgacacggatgccgtcgggattaaatgtcacatcaaaatcatttttgatgccggtctgcttaatgagccgcttgaccgccgcggcgtcagatgattgcgctgcggtgaggatgcggcgcgcaagctcttttgacgccgacagccgcgcaaggagcaggcgggcgtcctccagcatgcccgcagcctcttttgcggacgctgtcaaaatatctgcgtgaatcgtgggagcaggcgcaggattgcggtatggcgcggcgaaaacaggacagcatggatacacataaagcatgcggcggcctccttctgagataacattcgttatacatgagtataggcggcgtgataacgagttatgacatgcaaaaagaccacaatgcgggtgttgcggtcttttcggtgtttgtcggtggttatgcgacgctgttcgcccattctcttttgaaattgcgacgtcagggactatagtccttagcggtttgtcggaaaaccgttaaaaaaccagcagaaccaccagattgatctgcttcatcccaaacgtctgcctttatggtagttatatagtcctgttcgccaaatgctctgttcgggactatgggattaccgtggtttgcggtgtcacgcagatacttttacacatacttttcggtgaaaaatcccgcaaaaacgtttacactattagtaacagatcaaatacctaggactcgttcaccatacacaattcattgatctttcaaaaaaaggagtgtggaaacggtggaaaagaaattagaagaagtaaagcaattattattccgacttgaaaatgatatcagagaaacaaccgactcattacgaaacattaacaaaagcattgatcagctcgataaattctcatatgcaatgaaaatttcttaaaaagacttggaaacaagtcttttttttgtgcatttttcacccatttcatggataaagtattatacgattgttaaaaaacgaaaaacctgctgtctttcatcacctgcatttagtaaaatagaatgggagggtgaagacaattattgagcaaatgtgtttagatgccgaaacgattaaagggaagatgaaggaaattgttggggataaagtcgataatctacatttagaagagactcttttgaccttcattaatgaaaagaagcacttttcattcggtgtccttgctttccagcattatgttgcttttaagggtacacattcctcggaaatcacactactggccgctggaattgaacttttaattttagcttttgatatttttgacgatattgaagatgaagataactttaataaggcatggatgcaaactgaccatgctatatccctgaatgcggctacttctctgtattcaataagcctgcaagccatttgtgagcttgaatcaaacatcgatttttcaagacttgcaataaaatatgccctaaatgcaatgcaaggtcagcataatgatctaagaaatttcccggagactgaagaagagtgtttacatatgataaaacagaaatcaggatcgttaactgcaatgtcagctgttttaggggcgatgcttgcaagtggtgaatttaacgcaacaattgagaattattcttataaaattggcgttattaaacaaattgaaaatgactattatggtttatttgataaaagccgtagtgatataaagaagaagaaaagaactttgataaacttgtttttaaatcgtcagtttaatagtgcctcaaaaaaagttttaaatatgatgaattctaaaaacagctattactctctcatatcggacagaaattattttgaagaattgctgtgtaaagcaggagtcagacaatatgttttaatgttaattaaaatatatgaaaatgaaatttataacgaaatggaaaagttgaacataagaattaaactatggtgagaattatgggggagtaatatgaagaaacaagacattgtgaattatcttatagaaaatccaagagtgatccatcaattggaagagggggaagtttgcttgatcggaattccccattcaattatccccgcgattatagaaatattcagtaacagcacttataagaaaaaacctgaatttacattttgggatcaataatttttaagagagttgtgatccattgaggtattttattaagcatctttcaatcgcactgttgatatttagttttttctatattgcacatattatatactttacccagaatggaattttagtcggaacctatgttgttgaaacatcaaaacatgagtttgaagttgttaaaattacaaaatcttcttacggaagatacttgaatttaaaagaaggggacaaaattctacagataaatgggcacatgccttcttctcaaaatatcaaaaatggttatttagcaaaggctaataacttaaaggttgagagacgtaatcatgaaattcaattgcatggttcagaggatttgtctttaaacagttcagttagtttctttatttatattgtcccttgtatattatttgcactaagcttattatgtattttctatatatacaaagtcaatcgtataaaaaatacagtttctgcttatattctaatctgcttcttaatttttatatcgatagcttatttaagtgcaggcggtgtaacaagaggatatgagataaatagatatgttaatctttttacttttttaaatgtgcctgtactatacctgcattttttatatcaatattttaaagaattaaaaataaaattttcagcaaagagtatagtatatattctttactgtttacctgtccttaacattgttacagaactttttagatatcgatatgatttatactttgttagagacatgaatttattgtcattttttatcgagatactaatagtgtatatgtatattgtttattatgccattatttatagaaagagagatcatgcttatctattaaaagtgttactaatatctaacacaatagcttttttaccatttactgttctttatcttctttctgaagttattttaggacagtatatttattcagctatagtaactgctccgtttctgctcattattccattggcattggtttatcaatttgttgtcaacaagatttatgatatagattttttgttgggaagaattagatactatagttttttgtctattgttcctacaataggggttgtatggctgtcaatcttatatgaaagtaaaggtaatcattttaacaccattcaaatcactttatatgtgtttttgatttttttggcggtcttttacaccaaagaggttttagactataaattccgtttgaaacgtttttcagaaaaatacaattatcaagacagcatttataaatatacacagcttcttaaaagtgtgtcagctttaaatcaagtgtttatgaatctgaaaaagactatattggatgtattacctgtaagtaaggcttacatttttgaaatcagttcagacggagatattctttattttgataaacaaaacatcgaaccgaattggcagccgtataaaaaagaatttgataaagtcacatcagagattgggaagataattgaagtaaatcaaggatttctgatgaagattggagaaagaggggcaaattcatacattttgctctgtttatccagcattaataccccaaggctgacaagggatgaaatctcttggttaaagacattgtctttttatacaagtgtttcgatggaaaacattttacagatcgaagaactcatgaaccatttacaagatctaaaacaacaaggttcaaacccggtctggctcaaaaagctgatgtttacgattgaggaaaagcagcggtcggatttggcccgtgatctgcatgattcggtgctgcaggatttgatttctttgaaacgccagtgtgagctgtttctggccgattttaagaaagaagagccttgtcacatagaggtgcaggacaagcttcatcagatgaatgagcagatgtcggatgtgattttgatgacccgggagacgtgtcatgagcttcggcctcagctgctgtatgatttgggtctggtgaaggcggtatccaagcttgccgctcagcagcaggagcgtgcgccgtttcatatccgtctgaatacgggacggtttacggcggcgctggatttggatacgcagctgaatttgtaccgcatcattcaggaatttctttcgaatgccatgaagcattcacaggcgaatgaggtgctgattatgctgatcagcattcaaaataaagtgattctgcattatgaagatgacggggtcggatgcaatcaggaggaaggcagcggacaggcgatgagcatggggctttcgggtattaaggagcgcgtccgggcgcttgacggccggatgaaaatcgacacaagtgaaggaaatggttttaaagcggatattgaaatggaattgtaaccaatttatcactaaatcgacttggcagaagccaagtctttttaataaaatggaaatgaatgagtaaaagggaggaaaccatgaaaaagatactagtgattgatgatcatccggctgtcatggagggcaccaagacgattctggaaacggacacgaatctttctgtcgattgccttagtcccgatgccagtgaacaattcgttcttcggcatgatttttcagcttacgatctcatattaatggatttaaatctgggtgatgacctcagcggcatagagctttccaagaaaatcttaaaagagaatcctctctgcaaaatcattgtttacacaggttatgaggttgaagattattttgaagaatccatccgcgcgggtctgcacggtgccatcagcaaaaccgagtctaaagagaaaatcatgcaatacatatatcacgtgcttaacggacagattttagttgatttctcctatttcaaacagctgttgacccagcaaaaaacaaaaacgtcttcttcccctcaaagtgagcaggatcggttaacaccgagagagcgccatattcttcaagaggtcgaaaaaggtttgaccaatcaggaaatcgccgatgcgcttcacttaagcaagcggtcgattgaatacagcctgacatccatttttaacaagctgaatgtcggctcccgtacagaagcggtgctgatcgccaagtcagataacgtactataaaccttgaaaggagaatgacctatgaatctgaaaaatacattgctcggcgcactcggcattgaaatcactgaaaacacggcgggaagatgcgtcgcggttatgccggtggataagaggacggtgcagcctttcggatatctgcacggaggcgcatcagcagcgctggcggagaccgcagccagtgtcggggcccagcattttatcgatcagtcgtcacaggcgtgtgtcggacttgagattaacgccaatcatttaaaatccgtgaaagagggcggtacggtcacggcgattgcgcaacccgttcatacaggcagaacaaccattgtttacgagattaaaatttttgatgaaagagaaaggctgatctgtgtttcccgctgcacgctggctgttataacaaaataaacaaacagccggaaccctgaatcgtccggctgtttgtttttacaaatatgaatctttttttcgtttgatcacaaagtttctgatccctttataatcatcctgaacgcttcttttatcaagcgccgctcctgaattgtacgccgccctgcagatgaggtgcgccccgaccggagccgtcagcaggataaaaatcatcccgagcagtatttttacagaaatttctccggtcagcatccacaagtaacccaaaacgccgagcaatatcaaattaacgccgagtgtcgagccttttgaggaggcgtgggcgcgtgtatacacatcaggaagcctgagtgtgccgaaagacgcgaccagacagatcagcgatcccatcagaatacaaacggcgacggcccatttaacgatatcgatcattttcgataatctctcctttctccaaaaacttagcgaaggcaatcgtaccgataaatgataaaatgccgagcagcagaatgatgtccaaaaaggccgttgtttttatgagaatggatacaagcgcggtcatggcaatcagattaatgccgatcccatcaagcgcgacgacccggtccggtatcgtaggccctttaatgacgcgaatgacgtacagaagagtcgaaaccgccataatgccgagcgataattgcagaataaacgtaaacatcagcggctcacctcctgaatggctttctcaaaagagacacggatgtcatgaatcgctttctccgcatcttcaatgtccatggcgtgtatatagagaatcgaccgatcatcggagatatccatcacaagcgtacccggtgttaaagtgatcaacagcgagagcagcgtgatctcccaatcctccgtcaattccgtcttaaacgcgaaaatacccgggcggatgttcattttcggagacataatggttttcagcacgctgacattggccagatataattcttttataaagatcagcatcagtttgatgactgaccatattttccaaatataaaacggctgcgagaagaagcgccggaaaaaaaacagcgccgccaagcccgcgataaatccggtaataaatcccgccgtgctgaggctgtttgtgagaaacatccagcaaacagcgagaaacacatttaataatagttgaaaagccatgccatctactccttcaaaacagcttcaatgtatttttccggattcagcagattctcagccgtctgattgacatacggtgaaacccattcggttccgagtccgaacagaagcgacaataggagaaaagcggctgccggataaagaagtccttttgcggaccgtcttgcggtgcccggtatttctttttcttctccccaaaaagcggtcgtaaaaaccttcagcacggagtacagcactagcaggcttgacagcagaatcaatacggaaaacaatgtttcccccttatcgaaaccgccttccgcgatcttcagcttgcctacaaatccgctgaacggcgggatgccggccagagatatggcggagataaagaacatccagcctaaaaccggataacgggtgatcaatccgcccattttgtgcagactggcagtgcctgtcaacgcgataagcgtgcccgccagcataaacagggctcctttaatcagcatatcgtgaatcaagtaatacaccgctccttgaatggaggcaggcgtgttcatggcaatgccgaacaaaatcacgccgacggctgtaataatattgtagatgacgattttcatgacatccgaaaaggcgatagatccgattacgccgaataacaccgtcagcatcgcaagccacatcatcaattggtgggtaaagcctgtatcgtgaataaaaatcagggtgaatactctcaaaatggcatacaggccgactttcgtcaaaagagatccaaataaggctgaaatcgcagccggcggggcgtaataagagcccggcatccaaaaatacagcgggaatatcccgccctttaaaccgaaaacgacgataaacaggacgccgatgacggttatcagcccggtctggcccgattcgcttatttttacgctcagatcagccatattcagcgtgcccgtcaccgcatataagtaaccgacaccgatgacaaaaaacgcggatgacacaatgttaaatacgatatacttcaatgattctcttaattgaattttcgttccgccaagcacgatcagcatgtaagacgcgatcagcagtaactcaaaaaagacgtacatgttgaacagatcacccgtcaaaaacgctccgcttacaccggccagaagaaactgcacccctgaataatagaaagcgcgctcccgtttttctccgatggagcggaaggagtacaaaatgacaagcaatccgatgaccgcggttgtcaaaacaagcagtgcggcgagctgatctgcggcgagcacaatgccgtacggcgctttccagccgccgagcgtcagcgtctgaatcccgtgtgtaaaaaccgtctgaacgagaatggcgctgatgacgatggagacagcggaagcggcggtgctgaatatccgcatcagcataatgtgcctgttcataaaaatcagcagcaccgcggcaagcagcggcaccaggataggcaatatcacaaagttattcatgttgatcatttcccctcattcgatccatatcgtccgatttcagttcctgataggcgcgaaacgccattacgagcaggaaggacgtgacgccgaacgaaataacgatcgccgtcagtatgagtgcctgcggcagcggatcgacaaacaatgtgcttttcccgcccagtatgggaggggcgccttttttcagtccgcccatggtcagaagcagcaaatggacgccgtggcttaaaagcgcggtgccgataatcacgcgcagcagacttttagaaagcagcaggtaggttgccgccataaacaaaataccggctatgacagacattaagatttccactattcttcctctccaatcgtttgaataatggtcatcgtaacgccgacaacaacgagatacacacctaaatcaaacaaagtggccgtcgcaagctccgtattcccaagcaccgggagatgaaaatggccgaatgtatgggtgagaaagggcgccccgaataagaacgaacctgcacccgtcgcaattgcgataagcagacccacggccgctacataaataaaattgacgggcaaaatcgatttgacggtttttaaatcaaaggccaaaagcaaaagcacgatggccgaagacgtaatcagcccgccgacaaatcctccgccgggagcgttatgccccgctaaaaataaatagaaagagaaaagcagaatgataaaagatacaagcttcgtagccgtctgaaggatgatgtcgtttgttttttgctgtctcaacgctcttctccctcctcttttactttcgttctgatcatgctgtaaatgccgagtgcggcaatcgacagcactgtgatttcaaacatcgtatcaaatcccctgaaatcaacgaggatgacgttgacgatattgttgcctcccccgagcttatggctgtaagcggtgaaaaaggaggcgatgctgtcttttgttttttcgctggaagacgcgatcccgagcattgtcacgatgacgccgacgccgagagaaatgataaaattcgtcatccggaatgttcttgtcttctttttccgccgcattttcggcagatgataaaaacaaagaagaaacaaggcgacggatatcgtctcaatgacaagctgtgtgagcgccagatcgggcgctctgaaaatcacgaaaaacagcgcgagcgtgtacccgacaacaccgagtgagataatggccgtcagccgcgatttggcaaacacagtcgccgccgtcgcgctcaccataacgagggagagcacgatttcatacaggccgatttcagccattcctttcgttgtcacggaaaagccgcctttcatcacaaacgccgttccgatgagaatgataaacgccgcaaaagtatacagcagataatcccgcaagaatccggtcatataagatgacgtcagctgataagatcttttttccatattgcccgtcaccgcatcgtaaagccggttcaatgacagttttttcggaaacagtccgtacagccgctcccatttagacagcgtcacgtaaccgattgtgccgacaatgatgatcccgagggtcatcaataactcagccgtcaccccgtgccactgggaaatatggacgtggaatgtatctccgccggttaacagagccggataaatggaattcatcgccggttcaatcaggctgtaggacaaaacgttcggtgcgaaaaacagactgacggcgcaagcggcaagaattaccggcgaaatcagcatgccgagcggagcttcatgcggcgtcttttcaagctgatcaggtttgcgcgcgcctctgaacgttctgaaaaacagcttcatgctgtagataaaagtgaagacactgccgatccatgcgagaacggggaacagcacgccccacgtatcaagattgaaaatatctgcatgagcaatccgcagcatgcttgtaaagaacatttctttacttaaaaagccgttaaaaggagggaggcccgccatggaaaacgttccgatcaatgaaacggtgaacgttaccggcatgagcgccatcagtcctccgagcctgcggatatcccgtgtccccgtttcatggtcgataatgccgaccaccataaataaacttcctttaaaagtagcatggtttattaagtgaaacacagccgcggtcacagccaacgtaaaatactctgaatgctgataatgaagcgcggcggctcctgcaccgagcatagatacaatcataccgagctggctgactgtggaaaaagccagaatcgcttttaaatcggtttgtctgaccgcgttgaaggaagcccataccatcgtgatgagaccgactgaggcaaccgtccaaaaccagacgggtgaaaatgcaaaaatcgggctgaatctggcaatcagataaatacccgctttcaccattgtagccgagtgcagataggcgctgacaggagtcggcgcctccatggcatcaggcagccagatgtaaaacggaaactgcgctgatttcgtaaaggctcccagtaacaggagaatcatcgccggaataaagaacggatggccggcaataatatgcacctggttgaccatttctctgatactgaatgagtctgtcatcagatacagcaggataaagccgccgagcatacacagtccgccgccgacggtaatcaatagtgatttttccgccccgtagcgtgatttctcccgcttataccaatacccgattaataagaaggatgacaggcttgtcagctcccaaaacatataaagcacaatgacattatcgacgagcacaacgccgagcatcgcgcccataaacatcagcaggtacacataaaaggggccgagcttttctttgtccttcgataagtaaaaaatgctgtaaagagtcaccaaagagccgattcccgtaatcaataaagcgaataacagcccgagtccgtcaatataaacggtatagttaatgccgagggacggaatccattcggccgcataccggacggtctctccggccattgtaatagggagcttgctgataaagtaaacaaacagcacaacgggcaatatcagcacaaaccagcctgtatggacccgttttacccgtttatagagaaagggaacgataaatgcaaataaaaaaggcgccaaaatcgcgaaatgtaacagctgcaacaaaagacctcctttgcttgtttttcatcaagcaactgctttatgtaagagtgaaccaatcaattcacggtcataggacccagtacaaattatatcgcacttttttttaccctgctacggcataatgtattcctctctgtatttttgtggtcttttgaacccaaaataaatttatcaaatttcctgatctttgtatatacttttatctttcagatcaagctttaaaaaaggagctggtcagatgaagagaaaggcggcggcctgtattggaatattttgctctattatcgcaggaacattcatagcggacggtttttgcaaaggacggcagcagacggaggcagatgaatgggagagtttttttctcggtgcggaatacgcacacggcaagctgagtgcggctgaatcaatacaaacaccgtttcagccgcgtgagtatataagaatcgtctataaatgaaaagagttccggcaccagggcgcggaactcttttttgtgtgatgatcagcgttttcctttaatgtaagggatgccgttggctttaggcgcatcagcgcggccgatgaagccggcaagcgcgagaatggtcaggatgtaaggggccatcagcatgtatacattcggaatgtctttgaacaggggcaaaagcgagccgataatgcttaaactttgcgcaaatccgaagaacagcgccgctccgagcgcgccgatcggatgccatttgccgaaaacaagagcggcaagagcgataaagccttgcccggaaatggtagagtgcgtgaaatcaagcgcgatcgtggaagcatatacaccgccgccgagcccgccgaacagcccgctgatcatgacgccgatatagcgcatgccaaacacattgattcccatcgtatcggccgccatcgggtgttcgccgacagaacggatacggaggccgaacggcgttttgaataaaataaaccaggaaacaaaggccagtacgatagctaaaatcgacgtataatatacgtcagaaaagaaaatctttcctaaaaccggaatatcgcttaacccggggatgttcgctttgtaaaagggcacgggaattttatcagtctgagcttttccgtaaatcagcttgacgataaacagtgtcgctcctaatgcgagcatattgatcgccacaccggttaccgtctggtcggcacggaaagaaaccgcggcagccgcgtgaatcagcgagaacagcccgcccgcaatcatggcggcagccaaggcaagccacggagcagcggcaccgagctcgcgtccgaaaaataagttgaacatgacgcttgtaaaggcgccgataatcatcagtccttccagaccgatattgacaacccctgatctttcggaaaacacgccgccgagagcggttaaaataagcggagccgcatatacgagtgttgccgggacaataatggataaaatctgcaggaagtccacttacttcgcccccttattcttcaatttatcaaggatgagccggatggcgtagcttgatgccacaaataaaataataatggcgatgacgatgtcaacgacttcagaaggcacgccggattcaatcggcatatttaaggcgccgactttaaggccgccgagaagacatgccgcaagaaccacgccgattgccgtgctgccgccgagaagcgcaaccgcgatgccgtcgaatccgactccggtaaacgcgcctttaaccgccgcatattgaaaggttccgagtccttccatcgcaccggccagccccgcgaatgcaccggaaatcatcatggcgtacatcatattttttctgacgctcattccggcgtattgtgcggcgtgctggttaaatcccacagcccggaattcgaatccgctttttgttttatgaataataaaccacatgaagactgccatgaagagagcgatcagaatgccccagtgaaggcgggagtaatctgtcagctgctctaaaaacggcgagcggagcgacgcgctttcatgaattttgcctgttttgtcccggtgatcggtcatgacatcggaaatgagataattggttaaatgaagagcgatataattcatcatgatcgtgacaatcacttcatggacaaaaaaacgggcttttaaaaatccgggaatcagcccccaaatgcctcccgcggcagcagccgccaataacgcaagcggaaggtggatgtaagcgggggcgtcaaaggaagtaccgacccaaaccgcggcggtccagccgacaaggagctgtccttcaacaccgatattgaacaggccggtccgaaatgcgaacgccacagccaatccggacaaaatataaggcgtaatctgccggatcgtttccccgatgtaatacacctcgccgaaaatgccgttccaaagagccgaatacccgcttgcgacattgtagccgcttgcgagcatgatgactgcgcccgcagccaaaccaaggatgatcgcaatcagcggcacagccagatgagaaagtcgattaatcatgtattttccctgcctccatttgcttacttcccgccattaaaagtccgagctcctgctcgcttgtttcaagcggattgacgtttgcgatgatgctgccttcaaagatgacggcgatgcgatcgctgagattcatgatttcatcaagctcaaaagacaatagcagcaccgctttaccggcgtcacgctgctcaatgagctttttatggacgaattcaatcgcgccgacatcgagtccccgcgtcggctgggccgcaattaaaagatccggatttctgtccacttcccgcccgataatggccttttgctgatttcctcccgacagcgcgcgcgcaggcgtatattcatcaggcgttctgacgtcgtattcttcaatcaggcttcgcgctttgtcataaatcgcgtgtttatttaatatgccgaaagaagagtagggcttttgataataactttgcagcacgatattttctccgatcggaaaatcaaggacgagcccgtgtttatgcctgtcctgcggtatatgcccgattccggcttcagtcattttccgcggcggcatgttttgcaactgtctgccgtttaatgtgatcgtgccggcatgtgtttttctgagacctgtaatcgcctcaattaattcagactggccgtttccgtcaacgcccgcaatgccgacgatttcaccggctctgacagagagggagagctgtttgactgcctcaactccgcgcgcgtctttaaccgttacatcagaaagcgaaagcacttcttgtttcggatcagccggttgtttatccgttttgaatgaaacttcgcgcccgaccataaggcttgccagttcatcttgatccgtctgtgcgacatcgagtgttgtaatgccttttcctttccggatgatggtgacacggtcgcagacttccataatttcttttaatttgtgggtgatgaggataattgattttccttcattgaccaggtttttcataatctgaatcagttcttgaatttcgtgcggggtcagcaccgcggtcggttcatcaaaaatgagaatgtcggcacctctgtagagggtctttaatatttccgcccgctgctgcatgccgacagaaatatcggcaactttggcttcgggatcaatctgcaggccgtaacggccggaaatatcgcgcacgtcccgggcggcgcgctttctgtcaatccggcccaatgttttcggttcttttccgagaataatattttctgagacggtaaaggtatccacaagcataaaatgctggtgcaccattccgatgccgagatcattggctttgttcgggctgttgatgtgaacgcgttcaccccgcacccggatctcgcctttttccggctgatacaggccgaataaaacgttcatgagtgtcgattttcccgcgccgttttcaccgagcagggcgtgtatttcgcctttttttacttgaagcgtgacgtcatcattggcgacgattcccggaaattccttgcgtatattaagcatttcaatgatataatccaccgatttgacgctcctttttagagatgctttgatgaaaaagagcttggcaaaagaaaagctgcaaaagatgcagcttttccttcaccgctcttttcaaaaaagagaggggataagcacgaaagtctccttatcccctgattcttactcagccttgaaggatttcaattctttttcagttgaagggatctcgagtccgtccgcgattttcttcttccaatcgtctgttgctttgatgacatcgtcagaaaggttttccttgtgatccgagatgccgactgcatcttgcgccaaaccgtatgttaatgttttgccgccagggaattttccgtcacttgcttttttcgttaagtccttcacggctgtatccacttttttgaccattgatgtaagtgtgacattgtcttttgtgccttcgacttgaccttcggcgtactggtctttatcaacaccgatgacccatacgttccgcttcggatcttcttttttaagatttttggcttcagtgaagacgcccgttcccgttgcgccggccgcgtgataaatgacgtcaacgcccgatttgtacatgctttcagccgtcgccttgccgacatcggctttgtcaaatccgcccgcatatttcacttcgacgaccgctttcggatttgcggcttgtacaccggcgcggaagccgatttcaaattttttgatcaattcagactccattccgcccacgaatccgacttttcccgttttgctcgataacgcagcggctgctcccacgaggaatgaaccttcctgctctttaaatgtaaggctcgccacgttgtcttttttgacaacggcgtcaataatcgcaaaattcgtgtctttgcgctgatcggcgatttcgctgatggaatcctgcatcaaatacccgactccgtatatcaggtcaaagtgttcccgcgctaatttatttaagttcgttgtataatccgcatctgattttgattgaagatagtcaaaaccgcttttgccttttgtaagccctttgtcttttccgaatgcctggatgccttcccaggcggactggttgaatgatttgtcatcgacgccgccgatatctgtgaccatgccgacggtaaagtttttgcttccggagccgtttgctttgtcacttgaaccgcatgcgcttaatatggttccggcagccgcgatgagcgccatcgccattccgattttgcgttttttcaaagatataacccccctgtaaaatatggctgatgctgttcctttcacactcgattcaccgtcccggatacagaatcgaaaaaactttctgataataatgatgagacgatctctctttttcccgcctaagcggctgtctcttccgggttcgggacttatggcttacctgaaaagatcagctaaccaatcataatttatcattttacccgccataaataaatagaaatttgcttatttttaaaaaatatcaattttacgaacccatttcctcatctggataaattataggaggttccgccgggtcattattcttatatagcattttgtcacgggggatgacagtaaaaaagcaccgttcacggcggaacggcgctttttgacattataaatattgttttatgctgctgacattgccggtgttgatatggtattgaaagaccggtctgccgatcgtgccgtacgccatctctacgttcagcacttgagtatcctccaaaaatttaaggtatttccggatggaaacttgtgagatttcagtatgcttggcgagatcttcagtggtaaaagagctgtctccgaaagattcgatgcttgcccagatgagtttaagcgtgctttttgtcaggcccttcggaaggtgaactttttcagccgcttctttcttttgaaaaagctccgcatccaattctttctgtgtcatgcttctgtgtgattgataaaccttctgcttgcgtctgtagtcggaaagggcggtttgaaaacggtcaaactcaaatggtttgattaaataatcgacggcgccgtaccgaagcgtttttttgatgacatccagctcgcttgcggctgaaatgacgatgacatcgaccgattcattttgtttgcggatttccgttaaaagctcaagcccgttttttcccggcatgtaaatgtcaagaaggatgagatcgatatgatgctcgcttaacacgtgcagcgcgctttgaaaggatgaagcgatccctttcagctgaaagccttcaatctggctgagatagcgtttatttaattcacccaccatggggtcgtcttcaactatgagtacattaatcatcattttcctccttcggttcatacggaatgcgaagactgaaagtcgttccttcattcttttcacttgtcacaatcatgtggccttttaaattttctgttgcctgctgggtaaaatagaggccgaatccccggtttgttcctttcgtggaatacccctgttcaaaaatgcgggtttggtcttcggcagacattccggccccggtgtccgtaatttctatattaagctggcgatcctgaaaccgcatcgaacacgtaatgttttttttcggcatctgcgccaccgcgtcaagcgcgttgtttaacagatttccgataatcgtaatgagctcatggatgacggcaggatccgccgcattcggaatcaggctgccaagctgaatgtctagatcagcgccctgttcgcgtatgtagctttgttttcctaaaagaaaccctgcgagaaccgggcttttgacatcgcttataatttcgcttgtttccgtcttttgctgaatagcgatatctttaatataagtgccgaggtcatcgtattcttttaactgtacaagtcctaaaatgacatggagcttattcatgaattcatgggactgtgctcttaacgcgtttgcatacattttaacaccggacagctgttctgctaaatgtttgacctccgttttgtccctgaaagtggcgattgctccgacggtttgccccttcagatgaatcggaacctcattaaagaccagctctaggccgttaatgcggatatctctgtcctgaagcggttttttcgtttcaatcacctgcttcagccggcttttcggaagaatatcgttcacatcttgatcgaccggattagtcggaatacccattttaataaaaaggcgtttcgcttccgcattggcaagcttaatttttccccgcgcgtcaaccgccaggatgccctccttcgtggattcgagcatggcgctccgctcttccagcagggtggcgatttcataaggctcaagaccgtacatgatgtttttgacggtgcgggcgacaatcacagctcctatgacgccgacaaaaatacttacgcagataatgaaataaagcggtctcaaactgtggcttacgacatcctgtattttgttcagcgaaatcccgactgaaacgacgcccacttgttttttatcttttccatagatcggaacgaaggctctcatggatttcccgagcgttcccgctgatgtgctcgttttgatatggccgtgcatcgccggctgctcgtctccgccggtgaatttcttcccgattttatttgcgtcggggtgggtgaggcggatgctgttcatatccataaccacgacaaattcggttcctgtcgtatgctggacgtccaatgtataatcccggagctctttcagcccttttcttgtttgcaatgcctgtgcgacacccggtgtttctgcgaccagttttgcggtgcgcagcgcggttgtccgttcttcttctttcacgcggtctgcggtctggacgctgatggtgaaaaaagtgatacaaagtgcgatcagaacgacaatacagacgaatatcgttaatcgggtttgcaattttaatgtttttttcataacagccttccttacgtttatcattcccgcgttctactttactccgaaaaagccggtttgtgaagatcgggctcatatttcgtaaaagtgaggaaaaatggaattttttatcttgtcaatgtgttttaagtcctccataataagtgaggtagattacagaaagggacttattatatgaaaaatacttattggacgggttattttccgctcgttgcgattctgctttttagttcgtcattatccatttctacctcgctttatgccatgaagatgcttcagtcgctcggcatgtatcaggggatgctggattatttctccgagaaagggatcagactggcgctttttgcagcgttcgcccttgtgtattttatgcttttttcggctttaaagctgattgcaaacacagtaacagagctgtctcttttgtttttcacaaatgaccctgaaggggacaacctgaaaaaaatcagattaggctctttaatttatgtaggcggaggaattctttcctttgcgcttgtgcagaatggtttctggattgcggcgttatttgccgtcgtcacgctcgtatatttgatcttcatggtgtacagaatctattcaacgctctcgatcgtttccctgatcggttttatattgtttgagattctgttttggtttacttttgttatcggtattttgtacatttttatcaagctttataatagcataatggctagcttacctgtgtaagctagccatttttgttaagacagaaatctgtttttgatctcaggggaggggagcatgcatgcttccctttttccgaaccatttgtaacgtcgccgggcgatgaaagaataggctctgtccctgagggggcggggcactgcgaaaaaaaccgaagacagccgccaggctccgcggagatgacgggcaactttcaataccgcttgggattttctgtatatccgcccgttttcgataaaaatcatgctgtcaaattgttctgtcggaagtccttctgatgccaaaagctcacgggcggtatctgattgcaatgaagcaaatgagatcaggccggccggatcgcgtttaatgatgaattgaacggcgccgttgcataagttgcagacgccgtcaaacaatagtacgcggtccggaagctgagctggtttcaaggtggatcccctccgttatctttaataggctgcttgcagcgtgtttttccagatcgaaagctgagggcttgcgtcatgaagatattcgacgcttgacggtgtatccttgccgacccatacccccattgtatatgcatccgtcaggccgacaaaccacatgtcgtgatagtcatttgacgtacctgattttccgccgacgtatggagctttaaagttcgctttttttcctgttccgcttttaacgacggctttcatcatttctttgatctgcatgttggtccgtacgctgaaaacctgcgtcggctggtctttccattttaatatcgtttttccttttaaatcagtcactttagtaatcgcgtgactcggcgtataaacgccgttgttgccgaacgtggtgtacgcattggtcatttcaagaggcgtcatcccgtttgtaaaaccgcccagcgccgcaggcagacggtaatccgcgctgaccagcttcgcgaaatgaaacggttcaaggtagctgaacgccttattgacgcccacgcggtccataattctgatggccggtgtgttgtacgagtatttaaacgccgtttccagcgttaccgtgccgtacgtgcggttattgtagttttgcgggcagtaatccgcactgcagaatttgcttgcgtcaatcttgctgtttggcgtggcgccggtcttttcaatgtaaggcccgtaatcaagcagcggcttaatggaagaaccgggctgtctgtaagcttgataggcacggttgaaatcatatttatgataatctttcccgccagaaagtgcgataatctgatgcgtctgatgattaatcacggccgctccgccctgaacgcctgcatacggcagattttgattcacttgggcgacgacctgattttgcatatacggattcagcgccgtataaatcttcacaccgtctttcaacagcgtgctgactctttcggaaagctcgctctgaattttttgtttcgcctttccggaagctttttcaagacgtttgtcatagccttcagatgatgaaacaagctgtgtgaattcatcatttacataggaaacatagtcaggatatttgtttgttttttcgtttatatcaagtttgatatgttccttttcggcttttttaagctgttttccggatatgacgcctgctttttttaatccgttaagcaatctgacttgtcgttttttcgtatagtcaaaatgcttgagaggatcatataatgtagggttattagggatggcgcagatgaaagccatttctcccagggtgagagatttcagcggcttgctgaaataaaattgtgccgccgaaccgacaccgtataccccgttattaaaataaatcgtatttaagtagccttctaaaatctcatctttgctgtattttttctcaagctgataggaataggccagctccgtcagttttcggctgaaggtgcgttcatggcttaaatacacgttccttgccagctgctgggtgatggtgctggcgccctggtcaattttatgatctttgaaattggaggcggctgccctgaccatccccataaaatcaaaccctttatgctcataaaaatgacggtcctcagaggtcaaaaacagctgttttacctcattcggtattttattgaagggcacgattacgcggttctcatgatcgctgacaatttcagaaacaaggcttccgtccctgtcatacatgtaactgttttgaaccagattgattgcttttaaatcaatatgtttatcgagcacctgatcaaaaggcttgatttgttttacctctttgccggaagcaataactgtaaatgcaaacaacgggataatgccaagcagcaaaatccatccgattattttacgtaccatggtcactctcttttctcctgatttctagccatatcgtatcattcttttaagaatacgagaaggttaaatttagaagaaatcgtgattgctgatcggtcagcccgcatttgacgctgtatccttttgcagatgtccggccatccataaaagtcccgcgcctgccaaaaagagaaaggcggtgacgtagaaagcagccgaaatggaaaaaccgctcgataccgcgcctccgagcagagggccgagcacatttccgagaaaccgaaagctgacgttatagccgagcacctcaccctgaatgctgcccggcgccctgacgcggatcgctgccgtaatgcagggcagcgtgccgcccatgaccatgccgaacagaaatctgaagactaaaaggatggagagagaggaggcgagcgcctgcggaataaaaaacaccgctgatgcgatcaaaagcacgattaagatccggctgtggccgaagcggtcgccgaagtctccccatttccgggcaagcaataagcttccgagtccggtagctgaaaacgccattccggagaaaaaagctaaattaacaggcccgtgcagctcattgacatataaagcaagcagcggctgaatgctgaaattgccggtttgcacgatcatggtaagcaccatcatcgcccaaagcgcgggctggtgaaaaatataggagagcacctgttttctggaataggttttccgcttgctttgtttctcgccgagcggctgctcgttgacctgaaataaaacgagcagcacggatgcgaaaatgacaaaggacgtaataaaaaacgtgtacgtaaacccgaagctgtcagcgagcagcccgcccagcatcggtccgaataaagtgcctgacacctgacccatctgcaaggtgccgagtgttttcccggcagtttctttcggcgtctgcgccgaaatcatggcaagcgatgtcggaacaaagcctgtcacgaggcccattagcagccgcaggacaaacagctgataaaccgatgtcacaaaccccattaataaaatgcttgcggcaatgccggttcctgtaatcaaaagaatttttttgtagccttgcttatcgccgaatcttccccaaaacggagaaatcacaaacgccattaaaaacgtgacgccgaacacatacccgctccatctctgcacatacccgccggagtgggggctgatcgattcgatatacagcgaaagaaacggaacaatcatggtcatgctggcggaaacaaagaaatttgtaatccaaatgacgacgaagttcttcttacggacagaaataacatcaccttctttacttttcgtgtgtctaataataagtatataggaatgaattcggtatttgtatttttgatgcggatataggaaaattcattatttttagaaaatgaagaaagtttcagaggggaaactgatatactatcataaaatatcatttttgatcggaggaaaggcaggtgtaaaaaaagtggatcagcgcagtctgctcattattgatttcgaatttacgatgcctgacggaaaatacagcccgcaaaatttctttcccgagattattgaagcggggattgtcaaaacggtggatgacgaagtggctgaaacgttttcaagttatatcaaaccgaaaaaatttccgaagctgacgaaacggtgcaaaacctttctgaacatcactcaagaagacgtggacggcggaatcacgtttaatgaattcatccgcaaattaaatgagcttgatcctgataaaaactgcacgatcgtcacctggggcaatatggacatgaaagtgttaaagcaaaattgcatgtttaaccacatcccttttccatttaaaggagaactccgggatctgtcccttgaatacaaaaacttcttcggtgacagaacattgacgggcctgtggaaagcggctgaagagtacggcgataaagggacgggtacgcatcataaagcgctggatgatgcgatgacgactcacaagttattcaagcttgtcgagcgcgataaacaatatcttgaaaaaccgaaacctccgacgatcggcgatcgcgtcgatctgactgaactgtttcgccgggccacataaaaaaacccaatcatgccgactgggtcaaagttctttaaaatagtcacgctctaacacggccaagctggcgagcgatcgtttcgcccattctgagccgtccgctgtgagctgatctttcagccgggcagccgcagcctgtaaggaagccgtataatcaggcacttcaccttcaaacggtttgaccatctggtgcggtatgtttgtctgttccccgtatgcaagcgctcttctttcatgaaaaaacggaacatccgcctgcttcggatgatgaagatctccttgagcgggatgcgtcagaacggctttaatttttactaaatagtgcttaggcctgacgtctgtcacttcccctatgtatgctcctgttttataaaacccttttacgattgtgccgatttcaaatgaatccatagcgttcacctctctgcttattctataaaagatcagcgcgattggctagtgaacagctgccggaagcctgacggaggccgttgtgcccgagtgctcgccgctggtgaaatagacggagccttcatgatgctgaataatcgagaatgtcacagtaagtccgagcccggtgccgttagtcttcagtgtataatacggcttgccgagtttctgaagttcgtcgtcggacatgccgattccgttatccgtaatctgaatgagaatcatctgttcctgtttttgaacggagacctcgattcggccgttttcagaaggcacagcttcaatactgtttttaatcagattaatgaaggcctgtttcagtttttttatgtccccgtacacatataaatccggctcgcttcgaacggtaaccgtcaccgatttaaaattggcgtatgactccattaaggaactcgtttccttcacgagcagagaaatatcaaacctttccttttcataatcatcctgcttcgccatatccagataattcgttatgatcgtctgagcccggtcgagttcggacagcacaagcttctgatacccggagtgtgatttgtcctgaagctgttcgccgctgaacagcagctgcacaaaacctctgacgactgtaagcggattgcggacttcatgggcgacgctcgccgcaagctcactgacgacagccattttttctgagtgtatcagccttgcccgcatggacgcattctcatcaatgatctcaatcaaataaatgcacagcaccagggcgctgacctgaaaaaatacggatattgccgcctcgtaataaatagaagatagattttgaaaattgaaaatattggttacggaatagatgaagacagctgcggttaataggacggcttcagtgcagccgatgagaagagcgaaaagcagtttcttccgctttgaaaaaaaaggccatttcgtttggagccggataggaatgatgattaaaaaaggaattaaggataagaaaaaaagagcggaaggttcaaaccatatgagctgagaaaaaacggatactgctcctgcggcaagtcctgcggcagttccggagtaaagcaggcagacgataatgggaatcagctgcaaaccgtaacggacggtatgaagttcctggatgggaaatgccgtacataataatgaagatgccgctgcaaatacggcgaccagcaggcggttcgctctcggcacaagcaaatcaggcttgctgagccagaagacttgataaagaaaaatagggaatagtataaaagagaagtgaagcaggtaatcctttacaatctccatttatgcgaaatcctttcctatgtaaatatgaatctattataacatctttaccggcaaaaaaagtatattttttctctaaagagaacgcccttatctcttctgataaaggcgttctttcggctgctaagcgagcgcttctttgattctctcgagcccttcttttacggcggcggccgaacagccgacattgagtctcataaatccttcgccgccggggccgtatttcgttcccggctctaaaatgattttcccttttttgagcattctttctctgagctctgcgtccgaaaacccgtattcgctgaaatccatccagatcaaataggaggcgtcaggcttcatcatgcggactttcggcaattcttttcttaaaaagtcctcagccaatttcatatttccctcaatgtaagggatcagcgcgtcgagccaagggccgccctttgtataggcggcttcgattgctgcaaccgcaaatgtgttgaggttggaaatcccgttctgatgcaatgcggcggagaatttcacccgcttataccgatcgggaatgataatggcggatgcctgaatgccggcgatattaaacgtcttgcttggcgcgacacaagtaacagaaatccgcgcaaaatcctcagacagagaagcaaaaggcgtatgcggctttccgtacagcatcaagtcggaatgtatttcgtcagaaacgacggtgacgttatgggcggcgcacagcgatccgagcttcaaaagctcatcccggctccacgctttcccggacggattgtgcggattgcagagaatcatcagcttaacctcagaatcgctcagctttttctcaagatcctcaaaatccatgcagtagattccgttttcttcccgtaatgggttatgtaaaacccgccgtttgttttcctcgatcatctgataaaaaggcgtatacacgggtgactggatcaaaaccggatctcccggttcggtaaaggcctgtacggccatgctgatcgccgtgacaaccccggggctgaacgtgatgcttgcgggatcgggccggtagccgtgccgagtatgaagccatgaagcgacggcttctcttgtattttcgtcaggagacgtataaccgaatatcccgtggtcaaggcgggcttttaaggcttcagtgaccgcttcgggggctcggaaatccatatcggccacccacatcggaagtgcgtccgatacgccgaataacgcttctgccgtgtcccatttcaccgattgtgtgccaagccggttttctcgaaggtcaaagttcatgtatgtcactcctgtagtatcattattttcacagtgtatctatggtaaaatagatttgcaaactttattataagcggtgatgaaaatggaagaaagccaagcggtcatgggaatgatgaaaatcattgccaagtgggacccgtttaaatatggagaagaattttatgagacagaagccgtcgatatcgttcaggccgtctatcgtgaagatcgtgccgacaagctggcagaagccattcaggatatctttgaagcttcatttgaacaaaaacttccgatcgaaggctgccaaaaggtggccgagcagctgctgttcataaaagaaagcagctcctgcaccccttaaaaaccggcgatatcgccggtttttgttattggataaattcaaaaatccgctccgaaacaaactccggacgctcttcggggacgagatgccccgtatctttaagcgaatacaaaatggaatccgggaggtcgcggtgaagccgttctccgactgagaccggcacgacccggtcttcttccccccatattaaaagagcggggttttgtactctcttcaaatcttcagagtccaaatcgccctccctgtgcctgatgaaccttgtcattgctttgaaaatctgccggtctgtaaatggtttttcataaccgtcaatcatttcctggtcgataagcgtccggtcatgtacgacatttagcaggtttttcagcacgccgtcttttgaaagccaatacttaagatacaagtcaaaacaagggatatgcgttccgaatataatcgacggatgcgagcgttttaaataccccgagctgcacagcaggacgattttagaaaaaagctctggtttaagaagagacgcggataaggaaatctggccgcccatcgaatggccgacgagcgcggcccggctgatattgagcttttcaagaagtccgatcagaagcttggcgaggtttgcataagtatatacgaacgtccgtgatttttccgattgtccgaaaggaggcaggtcaacggcgataatatcataatggtttctgagcagcggtatcagttttctgaagctgaatgccgaagataaaaaaccgtgtacgcagacgagtgtgtctctgccgggattttcataatgctcgtaatacagctcaactccgtgtatcgcggcccgtttaatcggtgaaacagcttccataaaaggcttcgccatcctttctttgttgtgatgtaaaggcttttttgattgtcagattttagctccggtttctttcgggtttttcttagcatttgtcgaaaatcgtgatataatgtcatgaagatttttgataatgcaaaggtgtgaaacatatgaagctgaccgaaaaagaaacagaaatattagaaattttagacgaaaacagccgcgttgacgcggaaacgattgcaaaaatggcgaacattcccgccgatgaagtcaaaagcatcattgaaaagcttgaaaaggaaaaagtcatcattgattatgcagctatgattgattggcgcaaagtcgacggtttggaaggcgtcacggcgatgattgacgtaaaagtcactccgaaacgaaatgttggctttgatgaagtcgctgaacggatatacagattccaggaagttgaatcagtatacctgatgtcaggggtgtatgacctatctgtcgttattcgcggcaacacgatgtcagacgttgcgagcttcgtgtctgaaaaactgtccacccttgattccgtcgtttccacgacaacgcactttattctgaaaaaatataagcatgacggcaaagtctttgaaagcggagacgatgacaaaagaatcgtggtgtctccgtaaatggaaacgaagacttcttatttatctgactatgtgcagcagattaaaccgtcaggcatccgcaaattctttgatctggccgctacgatggaaggcgtcatttcactgggagtgggggaacctgactttgtgacggcctggaacgtgagggaagcgagtattctttctttagaacagggctatacggcttatacggcaaatgcgggtctttatgaactgagagaagaaatcagccgctatttagatcagcggttcggcctgaattattcgcctgacagtgaactgattgttacggtaggggcaagccaggcgcttgatctcgctgtccgcgccattatgaatccgggagaggaaatgttaattcccgaaccgtgttttgtcgcctatgaatcactcgtgacactgacgggagcgaagccggtgccgattcagactaccgctgaaaaagggttcaaagcatcagcagccgattttgaagcggctctgacggacaaaacaaaagcgctgcttctttgttcgccgtcaaatccgacaggttccgtctattcaaaagaagagcttgaatcaatcgctgctttcgctgaaaaacacgacatcattgtgctcgccgatgaaatttatgccgaattgacgtatgacgagccattcacgagtatgggggccatccgcggcatgaaggagcggacgattcttatttcagggttctccaaagcatttgccatgacgggatggagactcgggtttacggctgcgcctcccgtgatcagggacgccatgctcaaaattcatcagcacgcgatgatgtgcgcgccttctatggcgcagtacgcggcgcttgaagggctgaaaaacggtcaggaagacgtggaaagaatgaaaaaaagctaccggagacgccgaaatctcattgtggaaacgctgaacgaaatcggactcggctgccaccaccccggcggagcattttacgcctttccttccattcagtcgaccggcatgagttcagaagaattcgcagaacagctgcttcttgaagaaaaagtagccgtcgttccggggaatgtgttcggcccgagcggcgaagggtacatcagatgctcctatgcaacatccattgagcagattcaggaagcgctcgtcagaatcaaacggtttgttgaaaaaagggcataaaaaaagatacgaacccagttcgcatccaaataaaagggggggaatactagaaagccttcgtaaacatagtataccctcctttttccgtgcttaaacatcctcataaaaaaagttctctttgcgaaaaacaaacttgtatgatataattttaaattgcgtataaactgtatttaatttaacttaggagttgttatgaatggcagcaaaatttgaagtgggcagtgtttacactggtaaagtaacaggattacaagcgtatggtgcgtttgttgcattagatgaagaaactcaaggacttgtgcacatttctgaagtcactcacggtttcgtaaaagacatcaatgaacatctttcaatcggtgacgaagtacaagtaaaagtacttgcagttgacgaagaaaaaggtaaaatcagcctttctatccgtgcgactcaagctgcgcctgaaagaaaagaaagcaaaccaagaaaaccaaaagcggctcaagtttctgaagaagcttctgctccgcaaggtttcaacacactgaaagataagcttgaagagtggattgaacagtccaaccgcaaagaccttatcaaaaaataagcatcaaaaaaaagcaccggatatgtatgttcggtgctttttttatgtttatctgacttccggatttgttgcttcctcgcgggatgtttcttcgttcggcttaaacagcaggccgagattgatcagaccggcgatgccgacaaggccgtaaataatccgcgacagagctgatccttggccgccgaagatggctgctactaaatcaaattggaaaaatccgatcagtccccagttaatagcgccgataatcgttaaaacgagacagatacgctgaataacactcatgtaaacaacctcctctatgaattcgtgaaacagttatagattgtgacaaagcaaagaatctatgcatactacattctccgccgtgaaaatcacactgtttcaagctatatctgtgccattcccgaggttacgacgtctgtaaaccgtatgatgtgccgtcaaaaaagcggattgctttacattgaacgtcatctttctgcataatataaatccaaaggaggagatgtcatgcaaaactttacatattggaatccgacgaaattgattttcggaaagggagaggttgaaaaacttcctgaagaaatcaagccgtacggaaaaaacgtgctgctcgtatacggaggcggcagcattaagcgcaacggtctttacgatcaagtaaccgagctgctgaaaaaagcaggagttaccgtacatgaattggcaggcgtagagccgaatccgcgtgtctcaacggtaaacaaaggtgttgcgctctgtaaagaaaacaacatcgatttcttattggccgtcggcggcggaagtgtcattgactgcacgaaagccatcgcggcgggtgctaaatatgatggtgacgcatgggatatcgtcacgaaaaaacaccagccgaaagaagcgctgccgttcggaacagtgctgacgcttgcggcgaccggatcagagatgaactccggatcagtcatcacaaactgggagacacaagagaaatacggatggggaagcccgctcgtttatcctaaattctctattcttgatccggtaaacacatttaccgttccaaaagaccacaccatttatggcatggtcgatatgatgagccacgtatttgaacaatatttccaccacacgtcaaacacgccgtatcaggaccggatgtgtgaatcgcttctgcgcacggtgattgaaacagcgccgaagctgatcaatgatctggagaactacgagcttcgtgagacgattttatatacaggcacaatcgcattgaacggaatgctgtcaatgggcgcaagaggggattgggccacacacaacatcgagcatgcggtgtctgcggtttacgatataccgcacgcgggaggtttggcgattctgttcccgaactggatgagacatgtactcaaagaaaatccggcccgctttaaacagcttgccgtccgtgtctttgatattgccgagacaggcagatcagatgaagagatcgcgcttgaagggatcagcaggctgtctgcgttctggacgagcctcggcgctccgaacagactcgctgattatgacatttctgacgagaagctggatacgattgctgataaagcgatggcaaacggcgcattcggacagttcaaatcactgcaaaaagaagatgtgcttgcgatactgaaagcatcattgtaatcaaataaagggggcggccgaattggcagctcctttttttctgtgttatagtaattcccttacgatttttttggaggttattgtgaatggagaactttacgtactacaatccgacgaaactgattttcggaaaaggtcaaatcgaccaattgaaaaaagagctgaagcaatacgggaaaaatgtactgcttgtatacggaggcggcagcattaagagaaacggcctgtatgaccaagtaacaggcatcttaaaagaagaaggcgcatctgttcatgagcttgcgggcgttgaaccaaacccgcgtctggcaacggtgaataaaggaattgagctgtgcagacagcatgagattgattttcttctcgcagtcggcggcggaagtgtcatcgactgtacaaaagcgattgcggccggagcgaagtatgacggcgacgcatgggacatttacagcaaaaaagtaacagcgcaggacgcgcttccgttcggcacggtgctgacgcttgcggcgactggctctgaaatgaacccggattccgttatcacaaattgggaaacaaatgaaaaattcgtatggggcagcaatgtcactcatccgcgtttctccattttagaccctgagaatacattcagcgtacctgaaaaccaaaccgtatacggcatggtggatatgatgagccacgtatttgaacaatatttccacaatgttgaaaacacgccgcttcaggacagaatgtgctttgcggtacttcagacggtaattgaaacagcgccgaagcttttggaagacctcgggaactataagcaccgcgaaacgattttatacgcgggtacgatcgcattaaacggcacgctgcagatgggctatttcggcgattgggcttcccacacgatggagcacgccgtatcagccgtatatgacatccctcacgcgggaggactcgcgattttgttcccgaactggatgagatacacgcttgatacaaatgtagaccgttttaaaaacctcatgctcaacatgtttgacattgatactgaaggcaaaacggataaagaaattgcgctcgaaggtatcgataaattgtcagcgttctggtcaagcctcggcgcgccgtcccgccttgcggattatgacatcggcgaagacaagcttgaactgatcgcagacatcgccgcaaaagaaatggaacacggcggattcggcaatttccaaaaactgaacaaagatgacgtgcttgcgatactgaaggcgtctctgtaagatcaggtttccggccggagtgattgcgtaaatcccgcagtcacccggccttcttcatgacttgatttagcggtggagttcatataaagtgaaagagaaaacaattcaccgttatggagggacaagcaaatgacgcatgtacgctttgattactcaagagcgttaccatttttcaatgaacatgaacttacatacgcacgtgatttcgtaaaaacggcacaccataatatccatgaaaaaacaggcgccggaagcgactttttaggctgggtggacctccctgaaaactacgataaagaagaattcgcgcgcattaaaaaaagcgctgaaaaaattaaatcagattcagacgtgctcctcgtcgtcggaatcggcggttcatacttaggcgcccgggcggcgattgaagcgctcaatcattctttctataatgtcctgccgaaagataaacgcaaaaaccctcaagttatctttatcggcaacaatatcagctcaacttatatgaaagacgttatggatcttttggaagacgctgatttctctatcaatgtaatttctaaatccggcacgacgacggagcctgcgatcgctttccggattttccgcaaacttctagaagaaaaatacggaaaagaagaagcgaaagcgcggatttacgcgacgacagataaagagcgcggcgctttaaaaacgctttctaatgaagaaggctttgaatcattcgttattcctgatgatgtcggcggacgtttctccgttctgactgcggtgggccttctgccgattgcggtaagcggggctgatatcgatgaaatgatgaagggcgctctggatgcaagcaaagacttttccagctcggaattagaagagaatgcggcttatcaatacgccgtcgtccgcaatgttctgtataataaaggaagaaccattgaaatgctcatcaactacgagcctgcgctgcaatactttgcagaatggtggaagcagctcttcggcgaaagtgaaggaaaagacgagaaaggaatctatccttcttccgctaacttctcaacagaccttcactctctcggacaatacgtgcaggaaggcagacgcgatctgtttgaaactgtattaaacgttgaaaaaccgaagcatgagctgactattgaagaagcggaaaatgatcttgacggcttaaattatttagccggcaaaacggtcgatttcgtcaacaaaaaagcgttccaaggcacgatgcttgcccatacagacggaaaagtgcctaacttaattgtcaacattccggagcttaacgcatatacatttggatatctcgtctatttctttgaaaaagcggtggcgatgagcggttacctgctcggagtcaacccgtttgatcagccgggtgttgaagcctataaggtgaatatgttcgcgcttctcggcaaaccgggatttgaagagaaaaaagcagagcttgaaaaacgccttgaaaaataaaaagaatggctggcccgccgcatgacgggtcagccttttttaaaccgtgaaaggtgtgatgatgaattggcacgactcttatggaagcatgccgtcatttccgtctgttccgccgttattgtctatcctgcgctgaatccttcttccgctgtcctcttacaaaccatcctgtttttcgctcttccactcgggttttttacggatatggtccggctgaaactgaagattggccggatgcattcgctgattacgaagtgctgtctctatgccgccgttttctttatttcacctgaagccgctgcgtccgcaattgtgacgtattttctgattgaatgcgccgttttctcttttcagcgtctgtctgcggctcctgattcttcccggaagccgtatgaagatgccgcagagcggggacgctaaagactaaaaggagcatatttacatgatcagcataccatcttcacttgaagggcaatcttttttattccgcgaattggaacaggtgctgaaaccgatcggttataccatcggaggcggctgggagtatgaccggggattctttgattataaaatttccgatcaggacggctatttatttctccgtatccctgttgaagcaaataaaggacggctggatgaacggggggctgccgttacaatcggcacgccctttttgctgaggcacgtctatcagcaggaaacggatgatacagcaggcggcggtgtttttgaatcattattcaaccaattctccgagccgaaacgccgggatgcagcaattgaccgttcatatatcgatatcggcatttcactcgtgaaagagcttgaagatgttctgctgcattaaagagccaaaaacagatcagtgctgagcacgtggtatgacaagggaggggtaagcatcggcccctcttctttttgtatgccgatgatcgtggtattccgcttgagataatagagcgcacaatcataataagataagccttttcattcctcggggacgggaatgatgcgaacctttttctccagcgtcagatcggacagcgtttgcggtttggcaagctgcagcttgacccggtaatgctcaaacatcacccggctcgacagccgtgatgtgcacagaatcttattggctccggcgcgttcggcgtttttgacataccgttccgttaaaatttctacgatacaatacacggacggatgcagccctttgatggcgagcagcgttaataccgacagcatatcagcttccgcttcattcttctgctggtctgctgtcagaatgacggtatcggcttccgtaatattcgccttattgagcgtgccgtcgtcagcagcgtgtccgcggatgaaatggacgttctcaataagcggcccttctcgtaatgaatcatcgatcaggacgacggtttttgatggtgcgaagtgctgcagctctttcagaagcatatgtgatttctcattccatccgacaagaatgacgtgccccttgcctttaaaggcgacccttccttcgacatagcggtgctgtttgctgaacacggctgaagaaagcgtggcgaaataggcggtcacaaaactcgctccgcttaatacaagcaccatgccggcaatctgcccgagcggcgtctggggcacgtaatcgccgtagccgaccgtagccactgtaataaccgcccaccaaatcccttcaaacacagacgtgaattgcttcggttcaagcatgtaaatcaattgaccgaacaataagatcaaggcgataatgatcaatccgatccgaatatataacggccatctcagccaggaaataaagatacggtttgatttcattcgtccggctcttccttcgacagagaaatggacaaaatctgcttaataatggtatttaatttttcgttcagctgttcctggccgtatgagtcacgcgcctgtctgattaactcggccgtctcatcctcgaactgaatgagaggttcgtcgttttccgattcattatagagctggataaagacgtcaagcccctcattcattctgtctatcgcattgctcagctgttctttttcgccatttgtcactttcatgatggatcacacctgtatcttttttttatacagtatgtcccagttcatttgatgtctttcaaaaatcggcgaaaacatattcacccggtttttttcatatgataaagaaacggaccgaaaaagggtgagtcagatgacagtcattcaaaaagtgctggcggcgctggccggagcgcagctgctcgcttcagcggccgtattgcttattttcgatttgaatggatacaatcatatgtccggcggcttttcatggcttgcttttgcaaaggggaccgttggcacgtttccgttttatactgcaatggccgggtgttttctgatcatgctcgcaggtttgattcctgtcagaaaaaagaagcggatttctgtacaggaaagcggccattcattaaaataatatataagcagttcgtacgatataagagaaaaaggaagaggataatatgctgtttgtctttttaacaattgctgcattgggattgtcgttttgggcacaatttaaagtgaaaagcaattttcagaaatactcagacgtggaagcttccagtcagcggacgggggcggaaacggcaagacggattcttgatataaacggtttatatgatgtgccggtagaaccggtaagaggcactttaacagaccattacgacccgacggaacgggtggtgcgtttatctgagccggtatattacggccgctccatttccgccatttccgtcgcttcccatgaagtcggacatgctttgcagcatcaggaatcatacggcgcgcttgtgctgagacacaaaatttttccggtcgtcaattttgcctccggggtcgcccctctgcttttcttgggcgggatgctcctgggcagcttgaatttaatcggactcggcattattttattctctgccgctgtttttttccagcttgtcacgctgcctgtcgagtttaatgccagcgcgagggcgaagcggattatcgtgtcggaaggattcattcgcaacagtgaagaacacggcgtgaataaagtgctgaacgccgccgcgctgacgtatgtggctgcggcgctcgtttcattattcgagctgcttcgttttgtgatgattttcttaaacggtcgtaatgagaattaacacgaaggaggtggccccttaccgtttgcggtaggggtttttttgcttatattaaaactgattctcattatgctgttaatcggattaacggccatctttgtggcggcggaatttgcgatcgtaaaaatccgcggatcaaaaattgcggaactggttgaaaccggagacagccgggcgcttgcggcgcacagggttatttcaaatctcgatgagtacttatcagcgtgccagctcggcattacgattacggcgctcggactcggctggctcggtgaaccgacgattcagcggattcttcttcctgttttcagcctgatcggaatgccgtcatccattacgcacgtcgtcacgtttattgcggcgtttatcgccgtcacgtatctgcacgtcgtcatcggcgaacttgcaccgaaaacgatatccattcaaaaagccgaagccgtcagtctgtggacggcgaaaccgctcattctcttttataaagtgatgtatccgtttatcaagctgttaaacggctcggccggatttttggtcaaactgttcggctttcattcagtgaaagaacatgaagtcgttgtcagtgaagaggaattgcgggtgattttatccgaaagctataaaaaaggtcaaatcaatcaatctgaattccgttacgtcaacaaaatatttgaattcgataaccgggtcgccagagaaattatggtgccgcgcaccgaaatcgccgccatctcgcttgaccagtcagttgatgaagccattcatttgatcatcaacgagcggtatacgcgatatccggttattaaggaagacaaagaccacattctcggcattattaacaataaggatttatttaaggcgtattttctcggccgttccattgaattaaaagaaattatgcgtccggtcatcagagtgattgaaagcatcccggtccaggaacttttgatccgcatgcagaaggagcggattcatatggcgattctcgttgacgaatacggcggtacggcggggcttgtgaccgtcgaagacatattggaggaaatcgtcggggaaattcgcgatgaatatgaccaggatgaaatgccgcacatcgtcaaaaaaggcgaacaccattatgtgatggacggcaaagcgctgatagaagaggtgaatgacctccttgatatcgccatcgaaaatgaagacattgacacgatcgcgggatggctcttaacacaaaaaatggagctgaaaaacggcgacgtgtttcatgccgaagggtgtgaattcaaggtgctggaagctgaagaccaccatatccgctttgttgaaattaaaaaaactgatttctgagcctcctgctttttgcaatgaggctttttttctgaaaaaaatgcttcttcatcccgctccttcatatgctgtaatgaaaggagtggcggtatgaaaacggattggtggaaaacggcggccgtctatcaaatttatccccgaagctttatggattcgaacggagacggaatcggcgacattaacgggatcagagcaaagcttcattacataaaagagctgggggcggatgtgatctggctttgtcccgtttttgactcgccgggcgcggacaatggctacgatattcggcattataaacaaattgccggcgaattcgggacgatgaaggattttgaccggctcctcgcggatattcatgcgctcggcatgaagctgattatagacctcgtcgtcaaccatacaagtgatgagcatccttggtttatcgaatcccgctcagcgaaggattccgaaaaacgggactggtacatctggagagacggaaaaaacggcaaagagccgaacaattgggaaagtattttcggcggatcggcatgggaatatgatcaagggacaaatcagtattaccttcacctgtttgacaaaaaacagcccgatttaaattgggaaaacgaatcgatgaggcagtctgtttatgaaatgatccgctggtggcttgataaaggcatagacggcttccgggtggatgccatttctcatattaagaaaaaagaaggtctccctgatatgccgaatccggacggtctcccgtatgtcccgtccttcccgtatcatatgaatggggaaggcatcatggatctcctgaaagagctgaagcgggaaacattttcacgctatccgatcatgacggtcggcgaggcgaacggagtgacggctgcggaggcggctgattgggccggtgaagaaaacggcgtctttcatatgatttttcaatttgaacacctcggtctctgggatacggatgagaatcaaagtatctgtattccggcgcttaagcgcgtcttgtccggctggcagaacagtctggaaggtaagggctggaatgcgttatttatggagaatcacgaccagccccgttccgtttcggtatggggtgacgaacggcttttgaaagaaagcgccaaggcactcgcggcgatgtatatgctgatgaaaggcacgccgtttatttaccaggggcaggaactcggcatgaccaatgtttcgttcccatccattgaagattacgacgacgtcgcaagcaaacagctgtatgaaaaagagacgtcccgcggtgttccgcatgaaaaagtgatgaaaatcatctggaaaaagggccgggataattcacggacaccgatgcaatggagcggcgcggcgaacggcgggttttctgatgcttccccgtggctcggggtgaacccgaatcacacatggctgaacgctgcatcgcaaatgcaggatgaaacatccgtataccatttctacaaacggctgatcgccctcagaaaaaaacatgacgtattgatcagcggaacatatgaattgctgcttccggaggaccggcagatttatgcctatgtaagaaaagacggaacggaaaccgccctgatcatcaccaatctgtccaaaacccccgccttatacaggcatcccggttatccgcttgattccgattcgctcgtgctcgcaaacatggaaacaacagcgcatcggcatgtgacatctgttctattaaagccttatgaagcccgcgtatatgtatggtgaaaaacttcagttccgagactgaagttttttgtgatctgcgtttatcatcgcgatccgacaggaaaagacaaatacagaaacgaatatgggaaaggaagagaaaaaaaggaaggggcattcatatgctgaaaaaattgcagattcaaacaaacagacgggatgaaatgatcgacatcacgcatgaagccgaagtatttctccgcgaaacaggcgtaaaaagcggcttggcgctaatatactgtccccataccacagccggcattaccataaatgaaaatgccgatccggatgtgaaaagggatatgctcagaaggtttgatgaagtgtatccgtgggagcatgaactggaccggcatatggagggaaatacggcggcgcatatgaaagcgagtacaacgggcgcctcccagcatgtcatcattgaagacgggcgcctgattctcggaacgtggcagggcatttatttttgcgaatttgacggtccgagaaacagaacatgttatatcaaaatacaggctgaaacgggggaaatcacaatgagtgagtggatggacgcattatcattgacaaagcccgtcatccaggcgccgatggccggagggcttgtcacaccgcgcctggcatcagcggtatcaaatgaaggggcgctcggaagtctcgcttcaggatacgtcagtccgcaggcgcttgaaaaacagcttatcgagatgaaagacctgacgaaccgctcctttcaagtgaatcttttcgtcccggaagaaaggcagatgcctgaggaggaactggttgaaaaatggaaagcgcgcatcccgagggcaaatgacgccaagccgttctccgatttgaaagaagaatggaatgattttgaggaaaaagcggagcttctgatccgttacggggtcaaagcgtgctcattcaccttcggcctgccgccggaaaaaacggcagaaaagctgaagaaaagcggctgtttccttttcggcaccgcgacaacgccggaggaagcgaaggcctttgaagagcggggaatggacgccgttatccttcaaggaatagaagccggcgggcatcgcggatcgtttctgccggttaaaggagaaccggctctcggccttatggcactgattccgcaggctaaagacgcgctgaaaatcccggtcattgcggctggaggcatttttgaccgccgcggggtgcaggcagcccgatgtttgggtgcggacggtgttcaagtgggcacaccgtttctcctttgtgaagaaagcagcgcctcgccggcatatcaaaaagccattgccgaatcaaaaggagccgacacgcggctgaccacattgttttcgggaaaacaggcgcggggaatcgtgaatcagttcatgaaaacatatgaagctgatgaggggaaaacgctgccctatccgctgcataatacgctgacaaagccgatgcgagggcatgcggctcaatcaggagacgcggagcatatgtctttatgggcaggccagtccgccgcaaaacttgaagggccgacagacgtgaaaaccgttttggacgctttgtgctgatcataattacgatgctgtgaggtgatggatgatgaagattcttcaaatgtcctataaaaaaagagggaatattgagtttgtctttgaagattttccgcattccaaagtcaccatggcgccgattaaagggtattactttgtccggaccattaaatggagcagacgggacagagccgtcacccgccatgacttagagaagtttgaatgggcggcaaaccaagcgctcggcacgaccgctttttaccgaaaaagaaaagcatttcacatcccatcgtcaccatgacagacgatgggattgttttaatgcatgatctgataaagcgcgggcgcatcaagccttgtcgcctgagaaagcagataagctgactgcacggcattttttcttcttaaagaattcaatctctggatgatttgttcagcggtcagaatcccgagaccgtgggcaaaatattgatcattccccatcacaatgacattttctccccgccactgggcctttgcgggattaaactcagggtttttaaaatataaacaatctccccgtaaaaagtgtctgccggtttccgtgtagatcggcaggtgctcatagtgccagtcatacaaagtaatatcccggaaacggcggtcaaaccgttcttcaccgatcgtctttaagacggccagataataaatcacaacaatagcggtagcgcattcaaatgcataaaacgccccgttttcaataatatcccgtatcgctttggaagcggggattctgtacttcagctccagagctccttccggcgtcactctccaataagccgtatttccgtatgttttggcgaaagttgcaaattttgcgcctgatccgtgcagttctcttgcagcctccacgatatggcgccgcagccgtgcttcaaacatcagttcagtaattgacccgtaatcgaattgtacgggagaattgatcagttcatttaaatacggaacaaggctttcttccgtctgccagttcgcgatgtcctggggccgaagcacttggccggatatgataatcatctgcacgccccctctctttttttataagatatgcaggaggcttgggcaatgaaaatcaagtcataaaaaagggggaaatgttaacaaaatgtgaaggaggagccgatatataaggtatcacatatgagggagcaagcttaatatgaaaaaattcatcaattggtgtacaaaggcatcgatttcacggaaattaatcatttcatttatcgtgatcttaatcataccgattctcgtgttggaattcagttcataccatacggcgagcaattcgctggatgatcagatttcaggcaacgcgaaaaataacatcgactcttttaactcgaccattacaaatgatatcggcgcaaaagcaaaggcgattgaatttttcagtgaaaccttaaaaggttcatcattctctaaaaaaaataaaaccgaacttgaagaaaagttcgggcaatacacgtctattcataaggacgcagctcgtatttacggaggaacggaagacggcagctacgtacaggcgccgaaggaaaatgttccggccgattacgatccgagaacacgcgcatggtataaagacgctgtgaaggctggcggcacgctcgttgtcactgatccttacatcgctgcaaacgacggcagcatggttgtcaccgtagcaaagcagatgcaggacggaacgggcgtagtggccatggatattacgattgaccagctgctgaagcaaatgcaggaaatcaaaatcgggaaaaaaggcttcgtgtttataacatctaaaaacaagacttacgtcgcgcataaagaccataaaccgggtgataaagtatcaaccccgtggctgaatgaggtatacagcaaagacagcggcattatttcatacaagcttgataatcaagataaaaaaatggcgtttacgacaaataaactaaccggatggaaaatagaggggagtatggaactcaccgaaattaaagacgcctcaaaaccggtgctgacgatgggaatgatcgtgcttgcagcatccattatcatcgggggaattttaattctgctgattgtcagatccattacatcaccgctgaaacggcttgtccgctcgtctaaacaaatcagcggcggagacctgaccgaaaccattgaaatccgctcgaaagatgaattgggcgaactcggtgcaagttttaatgaaatgggagaatctctgcgcggacttataagcgcgatccaaaactctgtcgacaacgttgccgcttcatcggaagagctgaccgcttcagcttcgcagacaagcaaagcgacggagcacattactatggcaattgagcagttttcaaacggaaatgaagaacaaagcgaaaaagtagaatcaagttcagccaagctgaatcatataaatgaagggctcgcagccgtttcccgcacatcatcatccattacggaagcatctaaacaatcgaaagaagctgccggcaccggggaagaatatgtgcagcaaaccgtcgggcagatgaatctcatcaatcaatccgttcagcaggcggaagctgttgtgaaagggcttgaagccaaatcaaaagacatcactcatatactaagagtcattaacggcattgccgatcagacaaacctgcttgcattaaatgcagccattgaagcggcaagagccggtgaatacggacgaggcttctcagtggtcgcggaagaagtgcgtaagctggccgtccaatctgcaggttctgccaaagagatagaaaaactcattcaggaaattacagctgagattaatacatcgcttcacatgtttacatccgttaatgaagaagttcaatcaggacttgccgtgacggaccgcacgaaagaaagcttccagaatatcttcggcatgacaaacgacatcgccgagaagcttcaatcaatgaacggcacggttgaacagctgtcagacagctctcagcacgtctcagccgcagtgaccgatattgcggacgtatcaagagaaagcgcggcaagtattcaggatattgccgcatccgcagaagaacagcttgcatctatggaagaaatcagcacatccgccgatacgttggcgcaaatggccgaagaactgcgggaattaacgaaacaatttaaaatcaactagtacaaaaggacgctttccggatggaaggcgtctttttttatggaggcaggcagagaattaaataaaaagactcaccttaaaagagagtatatagaactatttttcatttatgactaaattttcaatgtaataaaaagggagtccgccgatataaacagtaaatgattgaaagaggtttacaaaattgagaaaaacagcaaaaaacatcgcaaaaaaatcaatagccagaaaactcatcttgtcatttttactgatcttactcattccggtagcagtattggctgccagtgcctaccgttcggcggcttcatccgttgaaaatcaaatgatggaaagcgctgaggggaatgtgcaaatcttaaacaatatgattgatgaccggatcggaacgtttacaaaaagctcagcatatttcagcgaatgggcgacaagcgcaaaatttaaagaaaaaaaccaaacggaaatgaaagaaagattcaagcagtttattgaaagcaatgataaagcggcagccatattttcaagcagcaaggaaggcgcgtttacacgttatccgcatgccgatatgccggccgatttcaatccgcttgaaagaagctggtatcaagaagccatggagaataaaggccagaccatcatcacggacccttatcagtccatctcaaacaaaaagatggtcgtcaccatggcccgtgccgcgcaagacggatcaggcgtcgtcgccattgatattaaaatcgacgatctcatcacgatgacaaaagaagtcaatatcggaaaagaaggatacgcctttatcctcagcaaaaataaaaaagctgttgcctacagtaatgaaaaagccggcgcggcggtatcgggaaaatgggttgatacattatacagcggggaaaaaggcgattttgaatatacgctgaacggaaaagcgaaaaaaatggcttacgtcaccaataaagcgacaggctggaagatcagcggaaccatgtccgttgatgaaattaaggatgcggccagacctgttttgaccatagccgtcatcatattggcgatagcggttgccgcaggaatgattttcatttattttgtcatccgctctattacaaaaccgctgaaacgcctcgtagcttcagcggaaagaatcagcagcggagatctgacggaaaccattgatgtcagttccaaagatgagcttggtgtgctcagtaaaagttttaatcatatgacagattcactccggtcccttattcagggaattcaggactctgttgaacatgtcgcttcttcctcagaagagctgacggcttcggctgagcagacgagcaaagcgacggaacatatcacccttgcgattgaacagttttctaatggaacggaagaccaaagtgacagcattgataaagcgacatcccaagtgaatgacatgaaagacggactcagcgatctggcggaagcagcagccgttgtgacggaaacttcaattgaatcggcggagatatcagtcgccggagagcggcttgtcaagaaaacagccgggcagatgggcaccattgatcactccgtcagtaaagcggaacaagtcgtaaaagggcttgagctcaagtcgcaagacatcaccagcattttgcgcgtcattaatggcattgccgatcaaacgaatcttctcgccttaaatgcggccatagaagcggcaagagcgggagaatacggacacggtttctcagtcgtcgcagaggaagtgagaaagcttgccgtccaatcagccgattcagcgaaagaaatcgaatccttaatccatgaaattgttaaagaaattcatacatcgctcggaatgctggaatccgtcaatcacgaggtgaaaagcggcctgcagctaacggacgaaacggaaaaaagcttccgggacatctccgccaaaaccaatcagattgccggtgaactgcaaaatatgaatgcaactgtggaacagctttctgccgggtctcaggaagtctcaaacgcttcagaggatatcgcggccgtctccagacaaagcgcggcaagcatacaggacattgcggcttcagctgaagagcagcttgcgtctatggaggagatcagttcatccgccgtcacgctcgaaaaaatggctgaagaattgcgcgggctgacaaaacgttttaagataaactcttaattaagtctaaaagactacttttagataggtaaaaagtatgcttcgttatatttcttcttttaggatatgtatatttacctataattgccgatatgaagggtaaacatgcaagaggagatatagcagatgaaaaaaattgtgcaaattatcaagcagagatcgcttacaagaaaactgctcatttcttttttagccattcttattcttcctatttcaacgctggcttttatcgcttatcaatcggcggtaagcacgcttgacaggcagatgatgggaagcgcattagataatgtgcagcagattaatgatatgatcaatacaagcatcagccagaaggaagacggcgcggcatatttcagcgattggctcaccaaggatcggtacaagccgaaaaaccaatcgcaaattacggataaattcagtgagtatataaaaatcaataaagacgtggaatccatctatacgagtgacacggaaggccatttcacccggtatcccgacctgcagatgcctaaaggatataatccgattgaaagagattggtataaaaaagccgtggaaaacaaagggaaagttgttgtaacagatccttaccgcacggcttccaccaatacgatggtcgtgacgatcgtgcagcagacgaaagacggctcgggagtcatcgccatcaatatgaaaatcgaagagcttctgaaaacgacaaaaaaagtgaacatcggaaaatcaggctatgcttttatcctgacgaaagacaaaaaagtggtcgcccacccgaaccgcacatcaggaacagtattaaacggggattgggctgaacagctgtacagcagtaaaaaaggtgattttcaatacacctacgacggtcaggaaaagaaaatggcttatgatacgaacgggctgacaggctggaaaatcagcggaacgatgtatctggacgaaattcatgaagcggcgctgccgatccttcatctgtccctgctcgttctcgtattagcgattgtcatcggaaccatcgtcatggtgctgattatccgttccatcacaaaaccgctcaaacagcttgtaacatcgtcgaaacagatcagtgaaggggatttaactgaaacgatcgagattcaatcaaaggacgaattaggcgagcttggaaaaagtttcaacaatatggccgcctcgctcaggtctctgatccataccattcaggattccgtgaataacgtcgcgtcttcatcagaggagctgacggcttcagcagagcagactagcaaggcaaccgaacatatcacactggcaatcgaacaattttctaacggaaatgaaagccaaagtgaaaaaattgaaagcgcggcggaacatatttatcaaatgaacagcgggcttaaagatatggcgaaagcatctgccgtcattaccgaatcctccgtcacatcagcggaagtcgccaattcaggcgggaagctcgtccaccagacggtcggccaaatgaacgtcattgaccggtcagtgaaagaagctgaacaagtagtgcgcggccttgaaacaaaatcaaaagacattacaaacattctccgtgtcattaacggaattgctgatcagacaaaccttcttgcgctgaatgcggcaattgaagcggcccgtgcgggagaatacggccgaggcttctcagtcgtagccgaagaggtcagaaaacttgcggtgcagtctgcagattcagcgaaagaaatcgaaagcttgattgtagagatcgttaatgaaatcaatacatctctcggcatgttccaatccgtcaacaaagaggtggagagcggacttgatattacgaatcagaccgaaacgagcttcaaacggatttctgaaatgacgaaccagatcgccggagaaattcaaaacatgaacgcgacggtagaacagctgacagccggatcgcagcagatttcaggagcctccgagcaaatcgcgtccatcgcaaaagaaagctccgccagcattcaggatatcgccgcatcggccgaagaacagctggcttcaatggaagaaatcagttcgtcttcggaaacgttatcccaaatggcggaagaattacgtgatatgacgaaacaatttaaaatagaataatagtagaaagacacccaaatgtgctgtttgggtgttttttttagtttttttaataaatcttttgtcctagctgacgataatagatttagctttcaaagaaggagactgaaaaaaatgaaacaactgatacattggatcaaacagccatccatcagcaagccgcttatcgcggcatttttagccgtattggtgcttccggtcggcatactcgcctacttcagctaccaaacggcggggagttcattagaaagcgaactgacccacagcgctcaaggaaatgtcaacgaactcaacagcgtgctggaaaacatgctcgacggcaagctgaaagcaattgactattacagtgaatcaatcacaaaggaaaaaatgaaaacgaaaaataaatccgaactgcttgaaaacatgaagcagtatgtcaccgtaaatgacgatgttgcatcagtgtatgccgcgtctcgcgacaaagcgttcgtgaaatatccgtccgttgacatgccgtccgattacaatccgctcacacgagaatggtatacaaaagcggttgaaaaaaacggacagccggtatttaccgagccctataaagacgctgcaaccggacaaacggtcgttacgattgctcagcagacaaaagacggatcaggcgtagtggcgcttgatataaatctgggagacctgctgaacgcttccgaacgcgtccagatcggtcataaaggatttgcttttattacaacgggagataaaaaatacatcgcccatccgactataaaagcgggaacagaaggctcaggggagtggacaaaagaagtattttcaaaaacaagcggaacgtttgaatacatctttgaaggacagcaaaagaaaatggccttcacgacaaacaaactgacgggctggaaaatcgccggcacattttttgtcagtgagatacatgatgcagccctgcctgttatgagaatggcgctgatcattcttgcggtgtctcttatcgtcggcgggattttaatcttttttatcattcgcgcgatttcaaaaccgctcaaaaaacttgtctcgacatcagctaaaatcagtgacggcgatttaacggaagtcattaacatcagttcgaaaaatgaattcggacagctcagccaaagcttcaatgagatgtcagcatcactccggtctgtcatcggtgtcatccaatcatccgtcgaacatgtcgcttcttcatccgaagagctgacggcatctgccggacagacaagcaaggcgacagagcatatcacactggcgattgaacaattctcaaacggaaacgaatcacaaagcgaaaaattggaagaaagtgcagaccatctttcccaaatgaatgcaggcattgccgagacggcgaatgtatcggcggaaatcactgaatccgccatccaaacctctgatacggccggaagcggagaagaattagtagcgaaaacggtcggccagatgaaaacaattgatcgttccgtacagcaggcggaagcagtcgtaaaagggctggaaacaaaatcgcacgacattaagagcattttgaacgtcattaacggcattgccgatcagacaaacctgcttgccttaaacgcggccatcgaagcggccagagccggcgaatacggccggggcttctccgtcgttgcggaagaagtgagaaagcttgccgtgcaatcagccgactccgccaaggaaatcgaaacgctgattcaggaaatcgtcaaagaaatcgccacatcgctttctgtattccaagcggtgaatcaagatgtgaaggaaggactcgatattacggatcaaacggccgaaagcttcaaaaaaatctcggaaatgacgactcagatttcaggcgctttgcagcacatgaacggaacgcttgagcagctcgcggccgggtcacaaaacgtgacaaacgcggttgaggatattaccgcagtcgccaaagaaggatctgccggcattcaagacatcgccgcgtcagccgaagagcagcttgcctccatggaagaaatcagttcatcagccgaaacacttgcccatatggcggaagaattgcagcaggttacgcggaaatttacgattcagtctgaagacgaagagcagctgtaacgagctgtttcttttccttcgctgaaaaaagcgatacacttacataaaagaagggagtggcagtgatgagattagaaggcaagaaagtcatagcgcttgtcagtgacgactttgaagacttagagctttggtacccggtctaccggctgcgggaggagggcgcgatcgttcatttaataggagaagaagccggccgttcatacaaaggaaaatacggcgtgcccgcgacagcggattacgattttaagagcctgattatccaggagtatgatgctgtgctcgtgcctggcggctgggctcctgacaaactgagaagatatccggaagttttggacatcatccgtacgatgaatgagcagaaaaagccgatcggccagatctgccacgcgggctgggtgctcatatcggccggaattctcgcagggaaaaaagtaacgagtacgcccggcatcaaagatgacatgacaaacgcgggggcacagtggctggatgaagctgtcgtaactgacggccacattgtatcaagccgccgtccgcctgaccttccgcattatgcaaaagcgttcgctgatctcttagcatccaaataaaaaacctccgcccgaagccgggcggaggtttttagttttgatcggcagggaagacaattccgatttgttttcttgcttcttccataatgcttgccgtaatgaaagaacgctcaaaggtattttcggaagactcctgctgtccgtttcgaagaagattgatgaattctgccgtttcgtaatacatcggcggtttcgaatcagggacggaaatgtcctccgtgcgtccgtcacgatagcggatttccgcccgttccggcccgtgaatgctgtccagtacgattgtgccgtcttcaccctgtatttccgccggggcaaacgaatttgagatttttgaatgcatcagcaccgcttcaaatccgtcatatgacagaataaccgtgccttcgccgtcaacgccggatgataatttgtgaccggtcgcaatgacgtctttcggtttgccgaacaggacgacggccggataaatacagtacacgccgatgtccattaacgatccgttcgatagttcaggtttaaacgcgttaagcaccgttccgtttttatatgcatcatatcgtgatgaatattggcagtagcttgccgtgaatcttctgatgggcccgattttatgtaagtggttttgaagcatgctgaagttcggcaggaacgtcgttttcatggcttccatcaaaagaacgccgttcgctttagctgcgtgaatcatgtcttccgtttcccttgcgttagacgcaaacggtttttcgcacagcacatgcttgccgtgttccataaaaaggatcgcctgttctttatgaaatgcattcgggctggcgagatacaccgcgtcataagcttcgctttctgccatttcttttaggctggtgaaataatgagcagcgccgtgtttgccggcaaactccgccgcacgttcctcagttctggaataaaccgccgttaattgaaaatcatcaatagcagaagccgcctccagaaatcgttctgtaatccaattcgttccgactgttgcaaatcgaatcattgctatcgctccttctatgtattggcttacattatagctgtttttcacagaaacataaatgaaaaaagactgcccggcaaagatataggaaaaattcccatagaggccggttattatttttcattacaggaacgatagtgtacaatttaggtaaaatacatatgatggaggaacaatagtggaaacattgcaaacatggggcggcagatttaaacagtttttcttggacaataaatttgtcttgtttttgcttgtattgctgctcatcggtctcaatatccttgtctttacgaagacatcatttattttcacacccattatcgtcctgctcaaaacaattgcgctccccgtcattttgacaggaattgtttattatctgctcaatccgatcgtagatatattggaaaaattaagagtgaaaagagtgtattccatcctgctcctttacctcattataataggtctgatttcgattacgatcgtttcaattattccgtttttaaaggaacagattatgagcctgatcgacaacctgccgaaatatgtggatattgttgaagatcagacgaaaagcctgatcggaagcgattttgtaaatcaggcgcaaaagacgatgaatatcaacatttccgatcttgcaaataaagtatcggcgcaggcggcgacaattgcaaacagcacatttaccggggtcgggaattttatcggcgcgctgacggaagtgatcatttcaattgtgactgttccgtttattctgttctatttgctgaaagacggcaaaaaactgccgttttatatattaaagtttgtgcctacccgtctgaaagaacaaacgtatacgatgctgagcgaaatgaaccacagattaagctcttatatcagagggcagatcatcgtcagcttctgcatcggatttttattatttatcggctatctgattatcggacttgattatgcatccctgcttgcggtcattgccgcttgtacgagcgttgttccgtatttagggccgaccattgccatcacgccggcgattattatcgctttggtcacgtcgccccttatgctgctgaagcttgcgattgtctggaccgttgtccagctcgtggaaggaaaattaatctctccgcagatcatggggaaaaatcttcacattcacccgattaccatcatctttgttcttttaaccgccggaaagctgttcggggttgtcggcattattttagccatcccggggtatgcggtcatcaaagtggtcacaacccatctgtttgattggttcaaaatgcgctcgcatttatatgaagaagaaaaaaatgatgctgtatcgaagtcataaaatcggaacggacatgatatttattataagacaggctttcctttaaaggagagcttctcttttgtaaatgacgaatgaagggaagaataggatgacactatgggagatgttcacagcagccgttttgggaatcgtggaagggctgacggaatacgcgccggtttcttccacgggacatatgatcatagcggatgacatctggctgaaatccggaagcctgatgaatccggaagccgccaattccttcaaagtggtgatccagctcggttcgatcttagcggtggctattgtatttaaggatcggatattaaatttactcggcctcaaaaaaaacgtgacgcgcgatcagcagaagggatacaggctgaccatcgcgcaaattgctgtcggtcttgttccggcggcggttctcggctttttatttgaggatttcattgaccgctacttattttccgtcagaacggtcgcttacggattaattgccggagccgtgcttatgctgattgcagactggatcaataaaaggaaagaaacgatcgatacagtagacagaattacctacaaacaggctttctgtgtcgggttattccaatgtctcgccttgtggcccggcttttcccgctcaggctcaacgattgccggaggtgtcattctcggcttgaatcaccgggcagccgcagacttcacatttattatggctattccgattatggcgggcgcaagccttctgaagctggtgaaatactggagcagtctttctcctgacatgattccgttttttcttgtcggttttatctgcgcctttgtcgttgctctcttagtcgtcaaattctttcttcggcttattaatcggattaagcttgtcccgttcgccatttaccgtgttatcctcggcattattttaatcatgttggtccgataaccgaagaggcccctcgagggtctttttttatgtttgaaaaacatctcataaaaatgtaggcaaactgaatttccggcttgaaatttaaagaaaactcgtctataataaaacatgacgttaccgcacggggccatagctcagctgggagagcgctacgctggcagcgtagaggtcaggggttcgagcccccttggctccatacctttaaacccttattttataagggtttttttatttgtctggaacacagcagagccaataacccaaaaaagtagttggggacaatttggggacgaaaatttatatcgacaaaaaagattatgaccataaactcaaagcaagagtcgaaaccccccatgctattatgccaaacattacagagaacctaagacaagcctcaaattttgtaagccctcgctctctttttgctttacctaatttccaataaacagcatagccggaaaacaccaaaatgattactccaagtcgtgtcatattctctaaaaattctataccatccattgattttcacctcgtttatttatgagaaaaaaataaagtagacttgtagagagtctacttataaacgcctaaccaaagtacacattttcttagagctcaaaacatttgagtgataaagtaagactcattttaaaatgtcacatccttatcccctccctatttatattccccatacattagttttattatcgcaaacagaatggttatttcaaacagttatgtaataataggtaacctataacttgtctaatggtataagaaacgagtttttctttatccaacaaaactatgatcatattcacggtaaaccgaaacaaattgcggttttttttcgtttaaacataatttggaaatgttagaatattatataaaaggaggagtggccttgtgagtcctgttttaccatcatcggaggttggcgttaagattaatgaatggtacaaaatgatacgtcagttcagtgttccggatgcggagattttgaaagcggaagtggaacaagagataaacgagatggaagaagacgagtatttactaatatattattctctcatgaaattccgccatcaactcatgcttgattatttagagccggtaactgtcagagtccgaccgacaatcgacgagttgctggaaaaaatcgaagcatcaaataaaggcatttccggcctgctgtgctattattctttattttttcgcggcatgtatgaatttgatcagaagcagtatgtaaaggcgatcggcttttatagagaggctgaaaaacaactcattcatgtgcatgatgaaattgagagagcggagtttcattttaaactggctgaagcatattacggtatgaaacaaagccacgtctccatgcatcacgtaaagcaagcgctcgatatttacgatcagtatgagttgtataaagtccggaaaattcaatgtctgttcgtcatatctgggaattatgttgactttaaacgttatgaaaaaagtttgccgcatttagaaaaagctttagagttgtcgaaacaagtaaacaataatgaaaggctgctcagttctgcttattacaacataggaaagaattacggagacttagaagaatacagtaaagctgaaatctacttaaaaaaagcagcggagatttctgaaaagtataaattgggcaaccttccgcattccttgtttacatacgcaaagcttctatttaaacaagggaaaacaagcgaggcgattcaaatcagcaaaaaaggactttcatcagctatatatcaaggggataagctgtttgaatctctgcaaaaatatttggaggctttatacattaacgcaatagaccaaatgggaatcaaaaaaacaattgattaccttgagaaaaataaaaactattcgtatgtagaagatattgctcttgatacggctgctgtttatgcagagtcaaagcaatatgacaaatcatatatttatcatcaaaaaatgattcaaacgcaaaaacaaattcagaggggagaatgcctgtatgaattttagaaaaggcgtatttatcattgtgtcggctgttgttttaatgtcaggggtcggtctaacggcatcggctgtttcatttgatggatcatatcaagtttcatctgatcgtaatcaaacctaagaaggagagtgcctgtatgaattttaaaaagagcgtcttcgtcgtcctgggtctgtcattgactttagtatgtgggttgggtatgaactcagtagaaaaacaagcacaagatacgatccaagtagcttctgatcgccttcaaacatgaatatattaggccttttcttcggaaaaggctttttttcatttgaaaacagatcaagcaagataacgtcttcgatttttccgcttttcaaataatcgccttagggcatgggagagttcgttagattgaccatccggcacgcgcgcgctgctttgcgcaagcagggggtgtgcttcgaaaaaactgtcatgattatatcctttcataatgaattcagactaaatgttaccacggaggaaagtgtaatccggtataatagtgtgaggttggaaggaaaaaagaattatttagtctgtgtctttattctttttttgcgggttttaaggaaggggggagaatgaaaagcaacagaagctgatttaaggtcttcaaccctctgcagcagcctctatatacttctccattacgaaataaaggaatcagagaaaaatgaaaaagaaaatccatcttatattatctctttcagcagtgctggcgcttttttttctaacggcgcttccggttctttctcctgtcgtcttcacgtctgcttcagaaaaaggagcaatcaggcatgaaatttataaaaaaggatatccgtatcaaagttactttgcgattcttcataaagaagaagacgacaatgaggcggggaatctttattatgtaaattggttcgattggaaagatgaaaccgggcagacgccgcaattatgttattcgaaaaaattacccgaaggtatgtacaaagtaagctgcggaaccggaccgtaatgatcaaaagcccttctctaatgagaagggcttttttgtcaaagagggatgcgccccccttaatatctccaatataacggctgaggataatatcgatacggatcgttcggataatgcgtatttggctgataaggcttattcatatcgtaaatatccgtgttttcagattgcccgcagtattgatccggacctatcacagttgatttgcggatcggtgaaacggctttttcccattcatgctcattcagacagtacgtatgcgccataatctcaggcggcgtcagacggagaatatccgagccgtaaatcacttcaggcgtatgggcgtcaaatatggctaaaagatgggttttgtctgaagtggcgatctcataatgccaccacccctgcggaacattcgccacttgtccgggggtaatcgggtaattttgtattttctgggtgaacgattcagcatcgacaccgttgcggaacccgaaatacagtacaccaattcagcggcgttttgatgggtatgcggttcaatcacatttgtcttgctcagaaagatatctaataatgaaatattttcaagcgtgtttaactgtttaatccccaatacattgataaagttccgatgatctttagtaaaaaaacggctctcattcacatcgtaagtgaactgtgtattaggagacgtgtaatccatataagaaaccatgcgatcccctgctttcatcttaaaacgtatatttccaagtatatgtatccctgtttcagcgggtgaagaaaaggaaccagaacccataaattccaaatttaacacaatattgtgacggcttttttaaagattcattttagatatatctttttttcgaaatatctcttactataaagatatattaaaaatacatctttagaagggttgaggattaacatgctggatgagagaacgatagacatcatcaaaagcacagtacccgtattaaaaacacatggagaaaacatcaccggacgcttttataacctgatgtttcaagatcatcccgaactgttaaatatgtttaaccaaactaaccaaaagaaacagactcagcgcgcggcattggcaaatgcagtcattgcggctgcggcgaatattgatcaattagagcaaatcattccggcggtcagacagatcggccataaacatacaagcatcggggtaaagccggaacattatccgattgtcggaaaatatctgcttctggcgattaaggatgtgctgcaggatgccgcaactcctgatattatgcaggcgtgggaaaaagcgtacggcgtaattgcggaggctttcatcggcattgaaaaggatatgtaccatgaggccggatggcagggatataaagaatttacggttataaagaaaacgaaagaaagcaaagacattacatcattttatattaaaccgagtgacggttcttcgcttcctgaatatgaagcgggacaatatatcagcattaaagtgcgcattgcggattcttcttatacgcacattcgccaatacagcctgtctgatgcttcccaaaaaggcgaatatcggatttctgtgaaaaaggacggagcggtttcttctcatctccacaatgaagttcaagaaggagataaacttgaagtgagcgcacccgccggagatttcaagctgtcttccgccaaaaaaccggctgtccttctcagtgccggttccggaatcacgccgatgatgagcatgctgaaaacagccgccgaaaaacagccggagcgttccattacttttattcatgcggcgaaaaacggagagtacgccgcgttccgtgaagaggctgagcaagctgcggcgaacaatccgaatagtaacgtcatgtatgtatacagtgagccgtcagaacaagaccgctcagtagacaagcctttttacagcggccggattgatcaaagcttcttagaacagcttcacctgaatcaagatactgaattttacttatgcggctcagcctcgtttatgacgcagatgaaagacatgattcttgcgctcgggtttgactctgattccgttcaatatgaattgttcggccctcagctgagcatggcttaataaaaagactcctctttgggggtcttttttatttgcacaatgtgttctttctccgtctttttccctattttattgaaattttcatcaatgaacagtaaaattataaatctagtgattccggaattaaaggaaggttgatatgaaaaagaaagctaagaccaaaagggtgctggggtgcctttttgctgtatctcttatattcggattatttttgatatctatggtgttttcgaaattcatagtgacggaagaaaaaccgccagaagaagtggacgggcagcaggtctttattgacagcctttccgggcatgctcagattttatatgagaaatatcatgtccttccgagcatcaccctcgcacaggccattctcgaatcggattgggggaacagtgagcttgcggggaaagcgcgcaatctgttcggtgtaaaaggtgattataaaggaaaacacgtcacgatgaaaacggatgaatttgaaaagggaaaacggaaaacgattcgggcaaaattccgtaaatacaacacgttctttgaatccatggatgaccacgccaaactatttgttaacggaacgtcttggaataaaaagaagtataaacccgtcatagaagcggacgattataaaactgcggcggctgcccttcaaaaatccggctacgccacagatcccgactatgcggaaaaacttaaagatgtcatagaaacatataagttgaatgaatttgacaaaatcaatgcctctcttaaagcagttgatatgaaaggcgccatcaaagaccacgccattgaagacgtatggtccaagccgtcgaaagagcagcattctattaaactggcatcggcgcaaaagtttaccggccagcatattaaagtcgtatccgaaaagcaaaacggagaatccgtctggtatcaatttcaggtgaaagacgagctgatcggctgggttgaccaaacggccgtccagttaaatgaagaaacataaaaagccggcggccgccggcttttttacattccttcagtttcaaatcttttaatatcacgtttatgtcccatcagcacaaggcagtcacattcgcggatgacagtctccggagaaggggtcagctgaatgtctccattatgtttcacggcaagaatggtgcagccgaacctggcccggacgccgagctccagaatggattttaaatgcagctttttcgtggctgaaagctccacgatgctgtattcatctgacaaatcaatataatttaagacgttttcatccgaaaggcttagcgcaatcttcacacccatatccttttccggatggataatacgatcagcgccgattttttcaagtactttgtgatgataataattttgcgctttcacccaaatattagggatgttcagttccttcaataacagcgtcgtcagcgtgcttgcctgaatgttggcgccgattgccacgatgacatattcaaaatttctgattccgagcgaatgaagctcgctttcttctgtcgcattcgcccgcacggcatgcgtggcataagaggagtatgcgttgacccgctcttcgctgatatcgatggccagcacctcatgccccattttaaaaagctctttgcagatgcttccgccgaaacggccgagcccgatgacggcaaattgtttatttttgattcttcccaatcctcataactccttaagaaactgttttcgtcactccaaatacaacaaacaagaatgtactcctgtttcaaaggtttgtcaatgtgagagccggaagaaagaaaacagcacaaaaaaaagaccggctgacaagcgatgggcttgtgccggtccgtttccgcaattatttgcagttgcaaggctgtgtcggcggtgtgctgcgtttttgaacaacaattgtgtcctcagcatagaatttagagccgatgcttaatgatttattttctgcgcggaacttatatgtacctgcagcaggcagcgttttattattaagagaaagcttaaattccgccgcgccgattaaatcaatgtttaacggaagtctgactgttttgccgttattcagaatctgtctttcacgcaaagcgtgtccgtttactgtatcttttgttgtagccgtaaatccgcttggaagggtaaattccataacgcctaagctcagaatcgtgttcgggcggtacgtcaattcgatatcagaaaatgaccattcctgctggctggcacctgtatattttgcaaataatgtagcagtcgcctttgtggacatttccggctcgtgaacggttgaacttgactcagcggcgaatgacgctgtcggcagagaaagaagtaaaaccaagccgaataaacttgccatgacagttgagaaaaacttgtgtttcattttcataaatccccctaaaaaaaatttgttgattgttcttaaaaaagaacgatcatacctataaaaatttaccatcaattttaatggaagtaaatggggttatcttcctatgttttcctgaaaataatcaaatcacgtcgaaaaatgacgaagaaaaaacgcctggttacgattcaggcgttttttcttccgtctctatcggaataaatttaaaaatctctccgctctgcaccgattcggcaagccgcttcagccaatgataataggcctttgagctttcaagctgatcgtataaccggcgtgcttcttcctgtaattccgtgctgccttcctctgccagcaaaacagcctgcaaatccgcctgggcctgtacgatggcggacagatttacctgaacttcccgatcccattttggcgggaagaaattcgtgaaaaacgtaaagaaatccttttccgctacaaacgtatgcttccgtgtgccgcggtgaaaggtttttttgaccacatttaaatcctgcagttttttgacgccggtgctcatactcggtttgctcatctgcagttcctcacgcatttcgtcaagcgtcatttcatctctcatatacatcgttccgtataaaatcccgacactccgggtgattccgtaaagatccatcgtctcggcaatggaatcaatgacaagatcccttgcttgttctatagctgcgaattctggattttcatccatactgtccctcttttcctcttgaagattaaatttgttaagtcatttctttatgtttttaatcttaacgaatcatgacaaaatgtcaaaacctaaacggacaagcccggttttgacaggtcaaaaaacatgtgttaaattaacattgttaaaaacattaaatttttatttaacaaacttacttttcggtaaggaggactctcatgagcaaaacgctttatatcggcggtgaatggatcagtgcagaaaaaaagcagacccgccgtatcatcaatccatttaatcaagaagaaattgcaacggtatgtgaaggagaccgggacgatgcggtgaaagccatcgccgcagccagaaaagcatttgatgaaggggagtggccggtgctttccgggctggaacgcggccagtttgttctgaaaattgcggaattaatcagacgtgatctgaacgaattagctgagctggaatcgcttgatacaggaaaaacaatcgaagaaagcaaagctgatatggatgatatcgcaaatgtatttcagtattatgccggtttggcggataaagacgggggcgaggtcatctcatctccgattcctgattccgtaagtaaaatcgtcagagagcccatcggcgtgtgcggacaaattacgccgtggaactatccgctccttcaggcgagctggaaaatcgctcctgctcttgcggccggtaatacgatcgttttaaagccgagcgagattactccgctgacaaccattaaagtctttcaattaatagaagaagccggtattccaaagggagccgccaatcttgtgcttggaccgggcgcctctgtcggtgacgagctggcgagaaacctagacgtcgatttggtgtcctttacgggcggaattgaaacaggcaaaaaaattatgcaggcggcaagcggcaacgtgaaaaagattgctctggagcttggcggcaagaatccgaatatcgtgttccaagacgctgatcttgaaacagctgcagatcaagcgctgaacgccgtgtttttccatgccggccaagtttgttcggcaggctcccggcttttagtggatgaagcgattcatgatgaatttttagccgagctgatcaagcgtacgaaacgcatcaaattaggaaacggttttcatgaagatacggaaagcggtccgctgatttccgccgagcatcgggccaaagttgaaaaatacgtagaaatcggaatcgaagaaggggcaaagctggaaacaggcggcaaacgtcctgatgatcccgcccttcagaacggtttcttctatgaacctactattttttcaaactgcaagtctgatatgcggattgtccaagaggagatcttcggtcccgttttaacagtcgagtcattttcttctgaagaagaggtgatcagactggccaacgataccatttacgggctggccggggcggtatggtcaaaggatattgaaaaatgcgaacgagtagctcaaaaactgcggatgggaacggtatggatcaatgatttccacccgtatttcgcgcaagcgccgtggggcgggtacaaacaatcgggcttcggccgcgaactcggcaaaatcggcctggaagaatacacggaagtcaaacatatttaccgcaacacaaaacctgcagcggttaactggtttaaagcataataaggaggagatacaatatgacattaaatatgaaagtagaaagcatgcataaattccatacatttgaaatcccgacagttattaaacacggaatcggcgcgattcagcacgcgggaaaagaagtcagagcgcttggcgtcacaaaagcgctgctcgtaacagaccccggaatttataacgcgggggtggcaaacccggtcattgaatccttgcaggaagcgggcattgaagtcgtcctgtttaacaaagtggagccgaatccgcctgtacgacttgtgaacgaaggatctgaactgtataaaaaagaaaactgcaacggtcttgtggctgtcggcggcggaagctcgatggatacggcgaaagcgatcggagtagaagcgacacacgaaggaagcgtgcttgattatgaagccgcggaaggcaaaaaaccgctggaaaaccgtattcctccgctgacaacgattccgacgactgccggaacaggttcagaggttacgcaatgggcggtcattacagacgaggaaagagaatttaaattcaatacgggcggaccgctaatcgccgcgcatttaacggtcattgaccctgagcttcacacatctatgcctccgcatgtgacggccatgacaggtattgatgccctcgcgcatgccatcgagtgctatacgatgaaattcgcgcagccgatcactgatgccgtggctttaatggccattgaatatgcggcgcattatattaagcgcgcgtttgcggacggagaagatttggaggcgagatacggcatggcgcaggcggcgatgcttgccggactttcatacggcagtgaatcagcaggcgcggcgcatgcaatgagccagacgctcggcggcatcatccctgtcgctcacggacaatgtgtcgctgctatgatgggaccggtaatggaatacaactggaaaggatatccggataaattcgcccgcatcgcccaagcattcggaatcgatacaagcaaaatgacaaccgaagaagcggccaaagcgtctgttaattggatgtatgacctcgtaaaagatttagaggttccgagcttagaagaacaaggcgtatctccggacatgattgagcgtttatcaaaagaagcgatgaaagatccgcaaacattcggaaacccaagagatttgaatgagaaagcatacaactggatttacaaacgctgctttgacttaacaccgaaaacagtataataaatgaatcccgctcctttacagagcggggttttttaaggataatgtcaagaaaaaggcggtgatggctgtgtggaagcgcataacagcaaagacggaaggcgtatatatagcggatacggaacaatttgttaccaaaaagatggacaagcttcgggcggaatacggcgggtttcccggtgacctgcatttcggactgacgaaaaaagccggcgcgcgtgagcccatgtatcaaagaggaacggaaatttttaaccggagacaaatttcaatcgtgtccatggaggaatgtgatgacattgcggaggccatggggatttctcatatctttcccgaatggcttggcgcgaatatcgcaatcagcggtttttctgcactaacgtcgcttaaagaaggaaacagaatcatatttccaagcggtgcgtctctgttgtgcgagggagaaaatgacccgtgcattcagcccggagaagtcattcaatccttttatccggatcagccaaaactcgctgcggcgtttgtaaggcacgcgataggcagaagagggattgtctgtattgttgaacggccgggggacatatgcacgggtgatccggtcgacattcattcttatgaaccgaaacgcgtcaagaaaaaaatcgagaaggtctgactcagaccttctcgattttttgtttgatttcttctatttgattgatgtgacgcatttcatgatgaccgataaaatcaatccactggcggatcgtcagttcttgaaaaacgggatgcggaagcacacgtttaaagtcttcctcgtttaatgatgaaataacggcggtcagctgctgtcttgccgtatctaattcttgttttgcttcaatgactgatattcggttttgctcaggttcgaggtgtgacggagccggccgtttatttgttctgtcctcgataaactccatcggtttttcttcaatttcttttaacggtgcgtcttttgcatgcttcgataaaagagtctgtgctgtttcgtcaattttctttaaatggtcaaggacttcccggatgctccactcatcagctgcgggcttttggttgaattcctcatcagagagtcctttcagttcttcccaggtctgctgtctggcttcattaaaaatactcatcctatctcctcctctggagtaaacatatcatatcggccttggataatcatgtaatcagcctctattgttagaaaattgaaaccattctcctttccgcccgtatataaagtaacactccgacatccgggccgaaaggaggatagtatatggacatatttcatctgccgcttgaaacgatctatctttacacactgattattgcggggagcctcacgcttttgattctgttttttcaagatgtttttcacggcctctcggaagccattccagttacatttttaaatccaacattgatattgtcgtttttgacaatcttttcagcctcaggttacatcggcgaaatcgccgctccgctttcaagtcctgtcattgcattactttcatttgctctttcagttcttttggtcagcctgcttcacttcttcgtccttgtgccgctttcatcagcggaagaatcgctcgtttatcgggagacggatttaaagggcagagtcggcagggtcattacttccgttccgaaaggcggctatggagaagtgataatagaaggaatcgggggcgccatttctaaatctgcggtcagctttgatcaagaacagatcaagtacggaacggccgtattagtcattgacgtgaaagacggagtgctttttgtgacgccgcatgaaccaatctgatttctaaggaggaactaatatgactatgccgattatcatcgtcatcggaatcgtattctttttacttatcgcacttattgctgtatttatcacgaagtaccggacggcggggccggacgaagccctcatcgtgaccgggagttatttgggaagtaagaatgtccacattgatgaaggcggaaatcgcctgaaaatcgtccggggcggaggaacgttcgtgctgccggtattccagcaggcagaacctctcagcttactgtcaagcaaactagatgtctctacacccgaggtttatacagaacaaggtgtgccggtaatggcagacggcaccgccattataaaaatcggcggctccatcggtgaaatcgcaacagccgctgaacaatttttaggaaaatctaaagaagaccgtgaacaggaggcgcgggaggtgcttgaaggccatctgcgttcaatcctcggctctatgactgttgaagagatttataaaaacagggaaaagttttctcaggaagtccagcgggtcgcgtctcaggatcttgctaaaatggggctgatcatcgtttcctttacgattaaagatgtccgcgataaaaacggctatcttgaatcattaggtaagccgagaattgcccaagtcaagcgggatgcggacattgccacggcagaagcggataaagagacgagaatcaaacgcgcggcggctgataaagacgcaaaaaaatcagagctggagcgggcgacggaaatagctgaagcggagaaaatcaatcagctgaaaatggcggaatacagaagagagcaagacacagcaaaagccaatgccgaccaggcatatgacctcgaaactgcaaaagcccgccagcaggtgacagagcaggaaatgcaaattaaaattattgagcggcaaaagcaaattgagttggaagaaaaagaaattctgcgccgtgagcgccaatatgactctgaagtgaagaaaaaggccgatgctgaccgttattcggtagaacaagcggccgcagccgcaaaagcgaagcagctcgcagaagcggatgccgagcaatacagtatcgaagcgatggctaaagcggaagccgaacgcgtgagaattgacggtcttgctaaagcggaggctgaaaaggcgagaggggaaaccgaagcggaagttatccgcctgaaaggtctcgcggaagcggaagctaaagaaaaaatcgccgaagctttcgaaaaatacggaaaagccgcaatccttgatatgattgtgaagatgctgcctgaatatgcgaagcaagtctcagctcctctttccaacattgataaaattaccgtcgttgatacaggaggaagcggtgaaaacggcggagcaaataaagtcacaggttacgcaaccaatttgatggccggtcttcaggaaagcctgaaagcatcttccggaatcgatgtaaaagagcttattgagaatttttcaggcaaaggaaacattaaacaaagcataaatgaacttactaaagaactcagagattcaaaagaagaacacagtcctgaataaaaaaacagcaggcgtacacccgcctgctgtttcagttcgcccgcttggattcaagaagccgcggagccgtcatgaataataaaataaggacaatggccgaaaggataaaagaaggaatcatataagtcgcgttgtagacgagcgaataaatccagaccggcgtgcctttcggagcatagcttccgaaaaagaccgctccggaaaccgtatgtgccgcatatcgcagcacactgccgataaaaacgccgcctataacatacgcagttaaggcgcctctttttttagctaatgccgattcgcggacaccggaagcaaacaagccgctgaaaccgagaaccgcaaacgccgcgatataatcgagaaatagctgcaccgggtgctgtaaaaataaattgccaatggcgatttggacaatccctgttaaaaggcctgtcgtaagtccggctttcactccccagcggaatgaaatcaaaaaaatcggaatcatcataatagagactgaaccgccttgaggcatccgaagaaacatacctgacacaatgtccagaatgacggcggctccagtcataatcgctatttcaattaagcgcacaagctgtgctgaatgattcatagttttccccctggtcagacaaccgttcaaggataaacaaaaaagcagcgcggggaaggatgggaaaaggtccgcgcgctgcttacaaaactgcaattcatttggctttgccacatccctacgccagcgttaactaacaggttcaaagggtcagaacaaaacgttcactctcagctttaatgctccccttgtggtcatcaagtatttagttcaatcttactatactagaaaatatgccaaaccacaaggcggcttatctttctatagaagagaaacagaaataagtatgaaagaaaataaatggtgactttttttaaaaaaactattgtcatattttcaaaagggtgttatattattaaacgtcgctgatgaacagcagacaaaaacaaaaagcttcgaaaacaacttgaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactatcacgttcctaacgatgggaaaattcgacctatcttatctgcataccataacgatctataggacgccttcttaatcctcacatactctttcgtttcaaccattacgcaaccacctctcagccgtcttaatcgcgatttctgcgtgctcaatcgtcaatggtaccgtgttttcgtcggtcataaatagtgcgttaccgacctttccacgctctttgtaccacatcattacgatatagcctccgtaatcgttgtaagtatccgacgcataattatcacttaaaggtacgtatcctattgatccgcaagaatcatcatcacggtcagaatgtccgagttcctccgataatctgcgcagtttacccatcgttgcgcacgcccagttatccggcgaaaacacgccattttcaaatgcacatatcggatcggagccttcccacgtttttccgcgttcctcacataaacgacataccattacgcaatccctcccgaaatttttataaaaaatcgaacacacattcgtatttatgtggtacaatatacctgagttaccgaaaggaggttcgattcatgaaaatatcaaccgaagataaagtagttatcgctcttacagcggcatttgttttcgcattcagaaagcctattttcgctcttcttggacgctaattcttggcgtccagccgccgggcgcactagaaccacgcatcatcctcgccgctcttctcatctcctccactttcaattaaattaatttgattctcaatttcctcaataaatctctctaaagcttcttcatcaaccaatacttgtccatgatggactttgatgatttctttcattcggtcatccatatttctaaattcttctgcttgttgcacagtaaacattactctgtatttctttatgtataaaagaaaatctttaagtactccgatctccccaattttgtggagattggaatcttcttgttccacttctagccggagtaaagatgcttccttttctaaaacatcaatttcaagctgttttttctttgacaacaattctcgctctttttgttgcaatcaatcacctccttataaggattcaatatgtattcacagtatgaatgtggattatgtctttaaaccgattcatactttaaatgcttgtttttctttttgctaattctatactctgcaattttcagtgattcaagagtccatccattattgtttaagcttccgaaaagtgtgttcaataattggagctcttgttttaagcttcttcgctttctcaatatcttttgaccttttaacgaaagatgatatccctctgaagcattaaattttgcctcttctaacttgtgataaaattcattgagctctttatcaactttccccagctctttatcaactttccccagctctttataaaggttatcaatttcattttgaagtcgttgtttagtctcctcaattgcaacaagaggtttggaaatggaaacaagataatcttttgcagttttcatatcgtcactcctatatattattttatttttattcttaaagtatgtaaaaaaaagacaagcttttaacttgtctttatcttatcattcaacttctcaaaagtctataactattttatttttatccttaaattattttgagtaagtcacaaatgaataattaaatgtggtattgttgtctacttttttgtgatccttttcaattactctccaatcgtcatttaacctgggaaaatatgaatcgccttctcagcaactgaatcaacaatcgtcaaataaaccttatcagcatgtggtaagaatgcctcgtatatagcgcctcctccaattaccattacttcttcatttgtatccagttgaccacgtataagcttcaacacatcgtcaaccgaatgataaacgaatgaagagtgatcaggcttgaaatccttatttttagtcagtatgatattccttcggttctgaagtggttttcctgtaatgtttacgattgattcgtatgtaagccttccctgtatacacagctttcctgtagtgagttctttaaaacgtttcatgtcttcaggaatattgtacagcaaattattctcatacccgatggccattgatttgtcgcagcaagcaataagagatagcattatactgctacctcaaagtaaagcttgtctccatgtttataattaatcaatttgaaatcatcaattgtgaaatcataaaagtcttttacgtttggattgatccatagttcaggtgcttcatattgctctctgtccatttgaatttttaaattgtctatatgacgagtgtacacgtgacagtctccaatattgaagatatactcacctagctcatatccagtaacttgagcaatcatacgctgcaatacattgtactggaatacattaaacggattcccgagcgcgagatcattactgcgacagaaaacttctaaatgcaacttcccgccttttacaagccattgagtgccataaacacagggcgtcaatgccatagagtctaattcatcaggattccaaagcgttgtaatatgtctgcgtgatgatggattatttttcaactgatgaataagatagtcaacctggtcaactttctcaccgtttagcattctgttcttcttaccaagctgatatccatatgctttgccgatcgtaccgtcttcttgtttccattgatcccaaatatgtacgcccatcttgtttaactcattaacatcatttgatttacattgccatatccaaagcagttccttgattgccgttttccaggcgacttttttagtcgttaaaattggtatttcggaattatcaaaccgcatttgtttactgattacacttagtgtatgtgctggtgttccatctgtatcccacttggttctgacatcgaattcttcgtctgatgccccattattaataatgtcatttatgattgtgttgtactgcatatcaaattgactcataatttccttcctttcaattccatcgtttggtaaaatattcttgcctacataatggaaagaggtgatctttttgtctatttacaaatacaagccagcagtggttaaagaagtactggactgtaaaactgaaagattaacagactcaattgaagcaagatattgtttatcaataaagcttaacaataatttagattcttcatatgtgtttattatgttaaatccaagtattgctgacaaagaagtatccgacctcactataactaagttgtgtaattttagccactcattaaatgaagttggatccattcatattgtcaatctctatcctttttacgaaacaaattcagcggaattatcctcaataattcataagcttcaaaaagagaacaggagcctgtatgaagctaccgttaagactaatcatcaaattatagccaatttagccaaagaatctaaaaaggtaatctttgcttggggtgattgtccaaaacgattcgataaacgaagttttaataaacaatgccaaaatgttaaacagctcctaaaaggaataaataaagacgaggcatttgttatcaaaacccattacaacaggcttctcacagttaagaattcgccaagacatccctctagacctggacttaaatggctcgaaccgtttcatgaattagacgcttaaatgaaacgaccaataataaagttaatcacgaagataatattaccgcaaacaaatagcatgtacacaaacttgttttgtttattgtttgagtcaccttccaaaacatcaagaattttaaacattgttaaaccggtatagattaaagcaaaggctgtccaagctaacattagcaagttaccgtgcgtgatcagtccaatagtagccaaggggataatgaacgaaatccccttgaacaatgtaatggcatatactaagttcttatttttcttcagttctttatacggtgagttagaaagcatatgcgtaactttagcgtatacgttctgatctcctcgtgtaattaatctaatttcattaatatttagtgcaaataagtatgctgcaagtaataacgtaaagtatgtaattctaatacatccccttattttatttttattctataaataactaaaactaatcaaacaactctccagctctcttcatgtctttgatgtcttcactaacactttctttgattgtctgaggtagctggtcaattcctcgttgtattcttttctgacctgtatttcttatatgtaaagttaattctttaaacccttccattgattcatctgaaattaaatcaaactgatgttgaatcttagctagtaagcttatatgttcttcttcatcctcgctgaataattggaggccttgtttaagattttctatttcttttagatgggcttttattttctctatgtgtttatccatgattgctaaacctttcaacaatttctaaaacttcagcgagcttatctgttagctgtcttcccaggtctgttttttgtttctgatcgagtttgttcatttttcctttgcccctttttgctttaatttgattctgtctcatataatcaatggaattttatctaaaacacatagttgcacacaactgggattgagactgcagttttctgcttagctctataaaaatcattcaccagctcaatgtcaccaactacatagctaatgtctctaagttcttcgatttttttatcaaccggaaaagtgtttggacagtatgtttttcgatttatcaatttaattagagcttcttcaatggtttgaatttcaaataacagagtcccatcatgtgtgctatttgcagtcagtttataatcaaattcttcgttaacactttcatcataagacacatgtccaagcttaagattttttaagtctccatgataatcatctaaataaccgcttcttttaaaaaagaaggcaatctgttcatttggatttaagtattctgtccgtttattcatgtttttcctccttattgttttagataaaagtcttcttttatagagatgttcgttcaatcgacatcctttggtatccctaaattttaaacttgtacatattccctttcctgtctacatgatagtgtccttttggataatatacatgtccatctgcatttaccttatcaattacattaaacatgaattcgccatgttttatattccctgtcatccacacctttttacgcaatctttttttcatccagcatctcctttgtaggtataattgttgaattatttgagtattttaagttgtaccctggctatgaccctccactggacaaacatcatgatctaagccagggcttgtattacttagttccagtcgatccgtgcccacctcgatcatcgtttcctagatgatctacctcaatcaattcaactgcaggcatctttttcataattctgaactgacagatccgatctccctttttaatctctgtatcacgcaatgcataagcaggaaagaaccagaaatcgttgtctcccttataagactcatcgataacacccattgagttggtttggataacgccaaagttcttatatgtacttgaccgaggtacgacatgtgcttcatagccttcaggcaattccatggccacacctaatgggataagtttaaattcatctcttttgatcgctacatcttctgctgcacgaagatcaatccaatcaccttgctcaattttgctgattcttgtttgggtttcatctaagtatttgattttaatttgcattatgtattagctccttttgtttttagtgtttgtaagttcttgtataaccttcttcagttaaacaaatgactctttattgtttgaactttgccctcaactcttcatatagtttacgatcacgttcttctttctctttgagatacttttctctttctgcctcttccttctttttcaactcattctcatactcttcccactctgattcatcgatcacccctttttcatgcaattctcttttcaaagggtgtaatatcttcttagcttcatgtgggtataaaattcttgtctcataaccatcatcccagtcagattgttgacaaaccataaacacgccgccatccttagtaataatagtcgtttgctcacaaaattgatttgcccaaacataagcaacttctttgccgattaacccttcctgattttcaatgaaatacatttattagctcctttaaatttaagtttgtttaaaattacccttttatcgtaattcctttaataacaaatcaagttcattgggcttaaaaccaatacttcggtttacttcttctccttgatcattcagcaaaatggttaccggtactcccataacaccaaatctagctgccacttctggttcctgtgtaacgtcaactgtctcaaattgaatatttgcttgttctaagtaattggacaccattttacatggattgcaattaggctgctctaatttaattactctcattatactgatacctcctcaaagtacttaagcacttttatttttccaattagatttcttaattagtttaaaagtccagccattgtagttcgagcgctcccctcgtaagcatttctgtattattgcacggtgcaagccgaactttttagaaaaaggtcgaaggccctctactcgtataatttcaccatcaggggatttggccataaagtgcaaacaagcattcgttaaatctcgatatgcattattgatttccctggtgacaaagcaacaagtttctagggaataaatcttttgacttttcggtattctttgttgtttcatgtctttatcaagaaagagttttcgcttattgaaaagatcctcatcatatccctctatctttgaaacatcttctagaaaattcttaaaacaatgccatctctcacaaactctaatccctgaaccgccatagttagaatactgtgggcaactgacatcgtaacaccgttctagcatccccttccaaacggagtatacattcttcacatctaccatctttacatcaccaagataccctactccgaacactgagcgctcatatcggtcttttatttttccacgtttaatttcaatcttttctacgtcccgttcgtatccggtctttatgaatcgtattctaaataattttgttccatttttcttttgtccatttgtccgtagaaccttatatttctgaccatgattattcgagaacacgctcccgatcagatctttttcaatcctcaaaataaaaatcctcattttttaaggcttcagcagtagccttcctgtaagaattccctttttgactaaagaagtccatagacttggtttttgtactcaatccgttcaacactactggattaatttcttcttcatggaaatagtggtcgaatcccagattatttaaggctttatttgcgttatagcgaataaacttttttacatcatgagttagcccaactggatcatataaatctgttgtataatcaagctcgttttcatataagtcgagcagcaaatcaatagtccatttatacagctcttttttcttgatttcagtttgtttgctatagatttcctgagccagtaatccagtgtatacgccgtgcagtgcctcgtcacggataataaggttgactatttctccgctattcattagcttcccttgtccgtagaaatataacggataatagaaaccgctgtagaaaaggaagctttccagatagacggaagcaaccatcgctttaaacagcgaaatctcatcatctttttttatggcgcggtacagtccgacgacggtgtgggcttttttctgcaagtatttattctgcttcacccattcaaagacttcattgatctgctcggttggagccaaagttagaaagatgttgctgtaagacttcgcatggacagcgttttccatcatggccataaagtttaatactgcttttctttgatgtccctcaacgtgctcggccacaatcggcatgcccgtgttcccctgctctgtgtctaataaggtaagcccagctaaaactttcatataagtatcttgttcctttgttccaagatacttccaagtgagaagatcgccgtttaatgcgatctcttccggaagccaaaactgctttacgttttggttgtaaaacatttgggtgaaatcatcttcatgctttgaccagtttgctgctgtatactgaatttttttattaatgagattttcctcccctgttatttgctataattatcataaataaaatgaaaagaggtttttgtattgtttatttctggagctctaccttctgaaactccttgcggtaatactgttatttatccaattaaaattgactctatgaacatccaagagaaaaaatctattatttttatgattcattgctttgagtctgccaagtcgtatcttgttaagccaaaacctagaaacggttctcgcgttggtcttgaatatataaaaaaaggagatcctaacactattgcaaacgaatacgctaagttaccttggccagaatttgagataaacgatgataatggaacattcacctataaagtagctccttcagatgaagagcgagactcattctttaaacaacgcaactaagacacccttcttgagtcgtatcctttgttcttgcataatacagtgttttaattcctttatgatgagcgtagagatctattctatttaggtctcttgtcgtcatcgtatcctttaagaacaacgtaaaagaaattccttggtcgacgtgctgctgaattgttgcaataagatcaactaccttaaacatatccatgtcgtatgcttccttataaaagaaccaattctgagccgataaacctggcattggataatatgtcttactgtttccgtatgtacgttcctcaattctctccataataggcattacaccggccgtagatgattgaacatatgagatgcttcctgtaggtgcaacagcttgcctatacgaatgatacaacccatatttcataacatcctctttaagcttcatccaatcttcaatgttaggaatatgttgatctccaaacaggcttttaaccttttcatatttagggctataatcaattgtcacgtacttatcaaaatactcgcctgatttgtaagttgatccgtgaaacttgtagtacgtctcccctgtttcttttgcaatttccattgaacgttgcagggagtagaagttaaccatcataaagtatgtatttgcaaagtccttagcttcttcactttcataagcaattttattttgagctaaaaaaccatgtagattcatctgcccaagaccaattgatcgcattagtgtatttgctctcgcaactgctggagcatttacaatgtttgttttccttgtgacagttgtcagtgagtcaattgctattctgactgttgaagcaattgattgattactcattacatttacaatgttcattgagccaagattacaagagatatctaagccaatttcatctacctgatcgtaatctgtataaactgacacttgtgacgcttggagcacctctgactttaatattcaacgaaaggcgcaacactctcgtccgttctcttatgaactgcttacgatcactcgtaagaatagactatatcatcgacctataaggccgcccgccgtttccatcgccatatgcttgcgatgtactctactcccttacgcgtatacgtggtttcgatagtcgttcggcatttccgcaaggtgcggtttagcacggtattgtctattgaatagagtttcaccgtttagacgggtttgctacgatcattgctgaccgaaggtgctacagttaacacaaattagaaaacttcacttttgaaatatgttcatttggatgcactttatttacattgtcagcaaacatgatataaggatagccagattcgcttcttagaatggccaattgctccaacaactttcgagcattgccctttgttttcctaactttagggttttcaacaagctcatcatacattttgttgatatccatctcatcaagatactgcccatattctttgtaaactgaatgaggatagagcatgtaaaaatccttatcttctcttgccaattcaataaatttatcaggaagcactacaccaatagacagtgttttaactcgaacatcttcatctgctgagatttttttggtcaactatccccctatttctaagggggctggactatatcttcatcttagtaagatgctttgcgcttcaaccggcgctaatctccggcttacaattagtctctacaccttccgagcacctgtaataatttttgaatttggggttgtttacacgactatttattgtgtttctactaatatttagtcgcctacctgcttctgacatagaatgatagtaaactccgtctacaataatcccgaccctatttccgttgttaagactaagcttaagacaagtttcttttgtcttctttcttcccttacgagataaagacattttttgcttagtttcctcagtgtgcttccttccatcaaaacgcttctttattttgctccgcattttctccatatgttcaggcttgtcgtaccaataattttttttccctgaattaattttggatgagttacgtctaactttctctgaatgagtcttcccaaacataggatttttttctcccttgtaagacattccaaatgcattgtcataaagattgtataactgttctttttcagaattggataggaattcttgttcttttttatatagatcaaaacgatttatgcaatcagagtgatacaaaacttcaaatcgaaaattattctctccatatgtattaaagtcttcttgtaatggcttattgtgatgtgaaccagcttttagtaatcctaaatgcgctgtcttccttttcctgaaatttgcgctacttcctatgtagaacttgtcgtttttaatatttcttattttatatacagccttcaatgtttcacctcctttcgtgctcggcttggcacgggattgccaccaccattatgtgctgaggttcccccgttagccctgaatcaggacaccgcttttgcttgcgttcacaaagttttcactgccatattgctataacaggcgactaccaattaatcgagaaaatcaataatatctggatggaatacatttagataagctgctccagacccttgcctttgcagaccattcagacgtgttcgctaagcacgcctcgccatacggctgcttcatgttaccatgaaggttagactatatcttcaccctctaagggtgcctcctgtttcgactgccaatagcttgcagcctacgcctttcggctagtcgttgcacgttcaagacgtttgatctaagtgtttccacttttgccgcaaacagatttttttaatgattgttttactcgcatatgtatgtatttcagagagttctttaatggacttaccacttttaaaatcatttaaaattgacagtgcttgaatttcagtaattttagcctttgggcttttttctccaatcaaaagcagttcatgttttaaagcatgctgagcatttccttttggtgtaacccactctaaatttgagagctttggattcgctttgttaccgtcgatatgatttacataaggcaaattttcaggattaggtataaaattgagtgcaactaacctatgtactcgtttaccaacctgcttaccttccttatataaggtcacttttacatatccttcaccatcaatcttagtctttaaaacagtgttctttttcaaattaatcactctgctatgatttgtaatcccgtacccagggaaatcaggaattggagtaactatctctcccttcattaaaacaaagggaatttgtgttttccttagccccatctttattgcacggtgattaattgcttctctggaaacgcccaatttttctcctatttcttttgcagtcattgaactataattttcgcgaataaaattctcatcaatatctaacttgttatgcggtcgtcttgcttcgctcatgattgtccccctttattttggcttgtgattgacccaaaccatctgaggagttcccatgaattaaagaggttttcgatcgccatttctgacgaaaggggccaaatcaacccatttggtcagcgtagcggaacgcattatccaatagtttcataacacctacgacgcctttagttgcattctctacgtctttaattgcttcacccttggctcttagtttgtttaggttcaatgcaacaccgccgcccaatttagacagctgcatggaaatatcgatcgttcttgaaatgtcgtttaaactgtctcccacttcaagcaagaaacagctcaccatttcgcctcttcgcttacgtcccgcattaagaaaagtaggtgttgccggttgatactcttgtttcatcattgcgtgtacttcctcaatagccttatcgtaatcaccatctgcacaatacaaagctacaattgagacgcgatcctcatatctctccaggatctttgttttatcgtttgtcttcaatgcatagtcattgtagaacttaaatgcactcatgaaagaagggaacctgaatttgtaactgtaagcaattttaaaaatcgatttaatctgctcaaatgtgtattcacttaagaattcttcttcgtaataatcatttttaatcagataatccagtttctcttttaaatcatggaaaaagactgtattttgattaatgtaatcaacaaagtaactgtgcacggcctccttatccttctcaaattgaaacttaccgtctttctgaatcatgatctcattattgagtttgatccactttggtattgtgtttgtcaataagttgtacctcccgattaatcttctgcaaatcttgttttgttccgcttagttcaaactttaataacaatggtacgtggaacattgctgaaagcttgtccccagctaaaccatagttatcaccccaaaccttgttaccactcaccgcaactccttttattttatttttattcttattgataaaactcaaagtcctttcaggtacttccccaaagcctatcgtatatgtaatatgtatgaactcttgagtgatgatcgtatcatcagttatttcaattgcctcaatgtctaactcttgttgcaacgcttttacaaaccttcttacattgccagttttactctcatatgtaatgatcactaatcgttataggctcctgtaattaatcttgtagttgcacattcagcttcattttcaacatgattaaatacttctgatatctcacgattaatgtcgcccatttccatgtagccctgtgccatactttcatataaggaactcttcttaactggaacgtaatcatctagattcttttctaattcaacaaattgatttccctgttggtcagttgcaataatctctccttttaatacaggaaaagattgcccatcagctaaatgaatatgagtgttctcatcggctattgtaaagctaataatgttcttcttttttacatattgttgagttggatcaatacgtctagctgcccccattttacatctccttattttttaatttcattttgaataaagctgtgattttatttaaactaaaaccaaaacattgtttttgatgtacttgtctatttctgattttgtataagtaagagtactgtcggttgtagtgtcagttatttcgaattgttcagtattatgattcattcttgctgtgtatacagtattgctgactacagcaatagcttcttctgatagcttaaatttaaattcgtttaaatcagctacttcatcaatctctcttacctcatgcggtactccgctttcttcttgagcgtacacagcatctttatgagcctcaatagcatcatcataagtgccaacaagtgttcccatgcaataaagtccgtgttttttattcattgtcatcatccttttaatttatttttgtgaacctcttaatctctttaccttcaacagccacatttccaaagaacatttctttaggtcttgcccaaagtaatccgtcttggtcttcatatgtaaccagcttttcttctgtttcagtgtgaatgacctctccaataaccttatacagaccgcctttataatgtctaaaccagcaaccaactacttcgtatgtatccttcaaagcattcaacaacttctgtgcatcttgagcactttttgaactgctgtcatatttgctgagatgtaaaaccgcttcctgcattttcaaattcactttgttcatccttcccggttcctcgaagtacattaattctattcaccatttctctaagctcttcaagcttcacttttgcattttcatattcccactctggataatacaaagattccagctccaaaattcttctcttgagtagattgagaacttctgataatgccttatccattccaatttcctcagcagttgtgtttgaatttatcagagcttctcgaatacgttgagacttcctttgacttatactaatgtctaatcatctccttaaaatcatccttttatgcagtttccaaaagctctttcatttagcttctctccactcaaaaccgatattaacgtttgcttgtttaggtctgataacttcaactgtgctacctctgtcagacaacctgctttttaatgccttcatatccttgtatggcgatatttgaaaggaactcagattgataagtataacttcatgtttatctttagcggcatactctctgtctagtgttctaacaatgtatacatgagcatcatttattttaatgaagtacccgtcctctatctctttcaccttcggcttatctgcttcgttctttctaatctttaaatttattggcattctcttcccccttatttctataaaataaaacttttaattaaatctcaatcaactgattcgtatttaacccttggataagttgtttgcatataaacttttttcatgcacaatggacattgaaacggatacttcggtgggtttgatgtgagcatcatatttgcaaacacgagctctggagcttcctcgcattcatcacaatgcaacgtctctctaaaaactttaacttgctgcgatttaatcatattcagattcctccttcgttaaataaacaatgtactaacatacagaacaatcaatgcaaaagctgaatacagtaaagacttacctgctttcttgaagatattctcgtttctttcttgatctgactgttttacacctttgacaaatatattaagtaaaacaccgataacaaatgaatgagataaagtaacatgaacattttgaatattgtatgtatcaataagcaatggatttaacacatgatttaatccgtaataaacaactagtgacatagtcaatgcttcaacaaaaatgagcaatccaactacaatcagagaacctgatccgataaagaaaccgttccgaatatcttttgtatccttattcaataaatatctctcctttagtcttttttaattagcctcttccaccaggaagttttacgtttttcttcttgctctttaaagcgttcatattcttgtttaagttgctgattaaattcctctattttatcttgtgtttgaatcgctttttcaaggctttctttatcttcaattgttttaattaccttgtcagtctgatatgtccattcattttttgtattgcgctgcctgtctgttacgactacgtattcgttaaaccctgggatatacactttcccttcgatttcaattgggtctaagtcaatgatcccttcaaaaaatggctggtatctacattgcttctcaattgggacaagggcatcacacaggtctaatgtccaacttttcttaattaccttaccttcaaatgttgctttatggcgtcccacttattcacctccttaaatgtaactgcctaatgtgtaatctgagataattccctcttcaattaagtaggacataatttcttggactttatcatgtatgatatgtggaaattcaagtttttctcttgtataagcattcatgtagtactgataatcatatggttgcaaacatctttcatttaaaatatctatttcacctttgagactgtttttatgtattgttaaattaaatgtgatgttaggctggattgattttatgaagtaccactttgatttcacgtgatctgtaaaaccaatatccctcatttgtttctcttcaagtatgtgaaacctcatttttctccctcattgatgattttctttaaggcttttaaaagcatgtttagtgatttcttgtcacccatttcatcccgattgacctcaataaagtgaattgctgacgttaatttatcctgcatttcagttgctcctttcaccataaaaattgaattttatctagacattgttgataatcagtaaaaccaaacctgccaagaataacaaaccagctaaaactaataatcctagagctatttgagcttttattctccttttaattccatatgtatctagtgaaactattccaatcaacaaaagacccgtgatttcaagaatgttaatgactagctgcaatattttcacactcatccagttttgcaagcttgcaccatactcctaatgagcctcctgctttcagttcttgggctgcagtcattgcttgctctcctttattaaatactgctacctttccatctaagccagtcatctttccaacgaattctttacctgcatagacctcaactacccatttttcattgttcatgattattctctcctcattatttgttttgatttgtcgtatactgcgcttgcccgggaaattgtgaatattccttctgaacattttccttgctcttgttcatatcactgtaagaataactccgagaaggagtgaacatcctccgattaagaaaaccgtaagataaaatggtttgccttctttaaagttcttattctcaaccaaacatgccattccattgcctaagaatattgatccgaataagatcagacccagtatcaaatatgaaattacattcatcgcagattatctccttatctactcatgagttgattcgcgattagctttcattgtagccacaaagctatcatcaaaagctttttcagttaatacatgcttgctatacggttccactaatgtccagattcctcttccttctttttcaaccctcaatgccaacttttctgccacttccagagaatcaaaaatcaaatcttctcctgtgacaaagttgttgtacactctgcctttatttgtctccccatcacgtctaaccactactacccattgttcttgtttcatttaacatctctccattctagataaaagtaatattttatttttactcttaaagtagttgcaagtattccaacgtcttttctaatttcatgtctttacaattctcaatgcattctttcttgattgcttctccgcattctttatgtacctggaattccctgtattctttgttgtcggatattcttatgtaataaacgatctcgcctatgtgatccttgcatttaacacactccaatgcatcacctcgcttcctatatttctaatatactcgcattctctcgaacaatcaacaactattttatttttattctcaaaaagtttcttttaaatttcttagctttactgttgcagccaaaatatccgaatcacaccttttccatatacggtcatcctctggccttaaattgttctctaagtaaacccaaagcttatccagtatctcctcaatctcatcaacgtcattattaatgatatccctggcaatatccctaattacccgaaacctcctctacgagaatatgattatagctttcccgttgtcattctttatgtacggcgaatgttttctctgaaggtaatttgtctccttaccttccccagtgctcacgttataaacagtctttaccttatgtatgtctaatgccttccgtttagcctcttctgtagacgttgcttcaattaccaaagacgcgttttcgcctttgtgattcctacatctaacatagtaccttttcaataaacatccctttatcctttctttttatcctgttgtattaatcctcttttaggtaagtcttaaaaaactcttctaggtttgcagcaattgcaccggcaacttctgcacaatgagcatgactcttttcttgagatcttaaaaactcaaccgcagacttagcaatggcttttattttcccctcgtctaatttgccgcttcttacttcatctttaattttttcggcttcctcttttaaactttctggatagttaaccacaggatcgattcacctcttgtattttatttttactctttaaaagacaaattttattcagattctttattaacgtatgtatgtattaattccttgaatattgactcaagtacagttacagtaattgaattgccggcttgcttgtacaactgcgaattactaattcccactgataaggctttctcaaaatcttcttcatcaaatgcttgcagtctccaacattctaatggagtgagctttctaattctgtattttgggtattcgccaattgctacaacttgacgatcaattgtattaacagtgaaggccggttcatcgtcttctttaaagcgtctgccattttgtcttttttcttccctttctggagttaagacgggtcttatttcagggtttggcacagaaattttcaccccttcacccttatttgttgttaaagttgaacttagcccatttgaattgtaaacctgaccattcattccttctcctgaaggattaatattaccaacatactcaacagcaattttaggttctctatgacctcctcccatagttgttaatgttggtgacaccccatcaggcgagtacactcttttaattgcatcatgtccttttagatcaatgtgaccaatcatgatcgggtcttccactttgtatagcgaagtctgccctccgagaccacctaccgattgggatgtcaaagttgttgcaatgccatttgaatcatagactctattgccttgtttaaagtttctggaatatgtttttccgttattcagccacctctttcctacgttaatgccaccaacaaacaccacatctttttcttttggtttttcaatttgttcaatcagtttagatgttttttcttcgcttaagtaatacttctcatctacatattcctcaagaatttctcgcaatctctttccaacaatatcttgtgcagaccatttaaaattgaaactttttatatttaattcttttaatctcttttttcccttacttaaaacatcgttccttcccttttcgacaatccattcgtcattttcaattaaatcctcacgaactccaattatgtatatacgctcacgattctgaggaacattgaaaaattttgaattaagtagctctaagtcaattctgtacccaacttcactaaaagattcagccataatatttaatgtatttcctttatcatgattgatcaaccctttaacattttcaaaaacaaaataccgcggcttcttctcttttaaggtatctatatattgaaaaaacaatgtccctctagtatcttcgaaccctttccgataaccggctacgctaaagctttgacaaggagatcctccaactaaaagatcaaattcaggcagttttttcttatcaatcttgcttacatcaccaaaatttgattgctcatcaacgttgtgaatcgcacaatatgacttaatagcatatttatcaatttcactaaagccaaccagttcatattcaaccccaatgtttcttagtgcagcttcaaacgcaccgattccactaaaaagactcattactcgtagtttattcaataaacaacctccatatattttatttttactctaaataaaattgatcttttaaatggaatcattcaaattattttccttcaattatatttctgactcttatgtttagtgcttcttgttctatttgaaaagaagtgtttgtctttatcgttaaatatgtatcagctagatgattggcaacattacggtatatcggatctgtattgtatctatgaaattgctcctcttcagtctcttctgtcaccagcttaattacctttaatgcttggtctagactttctctatgcttttcagtgttaataataattttcacctctcttcaaaagagatattttatagtaattttcgttcaatctctccccagttcataacacgaataaatctgttatcatccctgttatgcggtgcatcaaaaagtatcttcattccatcaaatgtttctaagttatgtactccgtcatcaatcatgatatctgctttaattatgtttttattgccacaaagcacaacattgctatgtggaataaatgggaaatgctctgtgagccattctaacttagctttaagggattctggatggtttgttgctgtagtaacaatatatacttcatattttttcgtcagctcctcaactgccctctgactcccttcaataacatccagatgtctgaacaattcataatccaaatgtctataaacattgttttgggtatttgaatatttgctaatatcccagcacagtatatcttcctcttttagaaaaggatcatcgtgggcattaatgtaggctacccaatcacttaataaatcagctaaaacttgatccatatcaattgcaattactttcttcataaatccccctaatccactaaaaagattatgcctttagcaatttcttcgctagaccactgttctgtatcccatgaatatgtatgtaatcctgcatcgctcattacttctctatataactctaagaccggttcaatgtctcgatcatttatgtattcgtcaccccgttcaagtaaacgttgcttaataacttttggatcagcatgtaagtagatcactttggctttatctctaatcttcttctcgattgttctttgctgctcttccgttaaaattgagtaatccttgaacttcttcgcataaaccagatttgaatatatgtatcgatcaataattacattgtcctcatcggccagcttgttgaagtgttcaaacagcttctcatttccgctcttggccaattcaaagctggatccctttattaccggatatccgagttctttgcctagcttatctgctactgttgatttgtagcagcagtcagtgccttctaaaataatcatcgtcatttatcttccacccttcttacattactgaagccaagcactctatatgagccgtctggatactcaacttctaattgttcatatcctttatcaacttgcgcaacaacaccaatctctcctgtgaaacccgcaatcaccttctctccctttttaaacatataattaacctcctttagctggatttaattcatgctccttgaagaatgtaatatcacctgtttcatcactgactgcgtaatcatatgtggcagagtgtagcagctcaataattttcccttcccgtccaacatgatgaggacaagcgttccttgcattctcatttatgatgacttttaacccttctggataagaccaaaacttaggcaattaaccacctcctaactaataattgagattgtccccttttgcttaccaaaattaattgcgtcacgctcggttgctacaagcaagtccactttatttccaacgattgcgcctccagtatcaattgcaattgctttgaacgtttccccaccaattcttacttcaacaattgaattcaaaggaataacgcttggatcgcttgcaataacacgataccctttataatagattgattgagtaacatcaacacctgttcttgttgttcctgtgcatccttcttggcagtgggcaatataagcactcagcttaacctggatggttttctttgcggccagcggcttgtttcctttccttttaatattaattttatttttactcttaataactctatgctttgccttctcacctcctctcatgtgccttttcttactttgcttaggtttaatgagttttgctgagacaatcttctctgtatgcctttttaattgctgttctttgttcgtttgagcttttttaaatagccgtgagacaatattctcacttgatggtatactaatctgtctagacttcttataaaatgattcttttattgagtcttcatttccctctgttttatgtaaatgttgctcataacttatgtaagaaaaagtggctaacggaattaaaatcatcataccataaacagatctgaaaatgtgtgtttttattttatttttatccataaaatttttattgataatcctgcctcctatgcttcagctcttttggttgttagactgatattccctttcctgtcaacatgatcaattctacagaccgtgtgactatagatgctgttcttatatactttaggaataaaattgttgcctcttctgaatccagtgaacatgagcaaagttcctctggtataccaagacttctcaacaacctcttttttgccgccagcaacaggtcgagaaatctgtttattataatgcccaaagctaccagcccactgtttaactgtaaccacccctgtaggtgtaaggagtgtgattgtgtgcttgtttttatccctgtctaatacggttcctataattcgagtcgtttcatattcatacagagtttttcctcgccattgatatggtttccctttgattggctcttctggcagctcataaaaatcagcaatatcatacttagcaaagttaacaccagaaagttcatgatcgttatagtaataactcaatgaatccatctcccatttaccaagagatccatcggcatacttagaccactctttcttaagtaagcaattgttaagtccacttaaggcttcttcagtcgatatccagtctttgattttggacattttactgtcatattcttttttaaacaatctttctgatacaacaagttgtccattaatcatatcaacgattccgctttcactgaaatgctgattgtaaaagtcggaagacatatcatctaataagaaaagcctgtcttttggagatttcattgtcttgtaaatctttttgctgatgtattctttgaaacggaagaatctaatttctaaagcatattcctggggaacaatatcgttttcgattagcatttttaaattcgataaagtcagcttggttttaggctcagatatcaaactaataaaggattccattattttttgtctatcaccaaaagaatcaaaacaaccaccttttattagttggattacctgtccttttttaaggatgctacttctgaacattctttcgatgaagtcgtcaaagtcactgtatggtctatttgcaattatttgatgaacaacatcgtcaccaattccattcattccttttaatccaaatataatagagttactttccgtatctgctttaaaaccaaaatttgcgctattgatatcaggtaaatcaactttaattcctctttttctgatattccctatagctgcagccactttcccatagtttgtggcggctgattttttggtagcctggtcttcttcgctttcaattccaccactgttgaccgttaaacaagctgtgctccaatataatggattgtacttatagttaaggttcaattcttgaagagcaataatagaatatgcaagagtatgcaggctgctgaacgagtatccgaattgtcttttaaattgtacttcccagacatattttaaaaggttttcagatgttcccaagcttcgccctttctcaaaaaacattgtctttattgcatcaatcatttttttgatttttttggctatcccttttcttagcttattagattcttcaatgctaaacccagcaatttctttgtccatggataacatcataactgattcctgtgtatctgcgatcccatatagaccttcttctggtttatacagatgttttttaagtacatccatttcttttgaacttaaattgtaatttctcatttcttgataccagtggtcgatgtcttttttaaatcttacatatgtatctacaggctgttcttccccttctgacatcagtctcattaaagaatttgttacggctgtttccaataagtttttcggcttaactttaacaacggattggttgcccacttctgtatcaaactgaaacaaatccattatttctccttcgccagccatttcccatattctcttagagttatactccaaagtgtctggatgcaaatacttagtataagttctttttaaagttccttgggactctatttgattgtcttcgataagctggtctaaggctactcgaattttatctaatccctcaatagtcaatagatcatacttaactgaacccattgcttcactgtcgcccatattgaactgtgtgatatatgctccttttggtgtcctcatcattgcgtttgatttggtgtattcatcattgaatattaggacgccggctgcatgagaagatcgtttgttagttaaaccttcaattttcagacaggtttctttcagattgggatatccctcgacctctctaataaattccttaataggctttcttcctaattcttcattgccaaagaaacaatcggagagagtccagtttgctcccctttcaaatggaatcattccacttaaatattgagagatgtcgttatcaattcctaagcctctgcaagcagtttgaagtgcggatttagatttctcagttccaaaagtgcaaatctgcagtactcttttttctccaaacttgtcccttaatgcttttaagattcttggacgcttagatccttcagtatcaatatcgatatctggcaaatctggtctcgatttatgtatgtgacgccaatgaggaaggttgtactgcattgggttaatttgcgtaatgtctaagaagtaatttactaaaaaacctgctgcgctcccccttgctgctccaactaagctgtctcctccacattcatcatcccaaattgtattgatgatttcccggacagtaacataataagatgacatggcctgttttagcttctcactaatttcccatagctcacccaattctagatcaatccgttttaaaattgagtgcaactcttttttagacatatcctttttcattagctttgccttaaaaccatcttcaattagctttaacaaatacctgtcctgttcttcatcagattcagccattaattttatatatttatatttctcataagccggcttgaacaaatgggataattcaaactcaggtaaagccatttttggaataattggttcgtgctcaatagtatagtcttcaatcatctctccaattagcaatgtgttttcaatggcctctttgatgatctctttgtccaagtagtccattctctcatgaatttcatcaacattctgaacaaaacatgcctcataaaaagagtcgacttctctctctccatccttggcgtttaaaaaggcttgatgaattgccctgtcttccggtctaagaaagtgtgcatcggttgtgacaatcactttcaatccataaccgttagctatattaacaagtttcttattacaataaatttgctcttcacttaaagctggctgaagctcaataaagaacttatctttcccaaagactttaatacaccatgttataaactcatgaatttttaatttgtgctgcttgattgactgaatgtttccactttcttcgcaatctttgattctgagtaaattgatattcacctcagagccgagacaagctgttgtagcgataatgtgacctggatctttgctaagcagttcttctacatcctttttaactgttggcactctttccattgttcctgtgtaaaatgaatttccccaggcttgtgaagacagtgttcttagctgctcatgtcctatagggtcgattgccaacattaaaaagtgcggaaactttgtctgtcctgacttataattatcacgaacttcttccagtgaatcgactaaatatgcttcattcccaagtatgagtttaaaatctgcaggcatatcccctttcttcttcatttctctgacagtcttaatcgcttccaaatgagctgaaagaacctcatggtcagtaatggctaatcctttataattcatctgaactgctgttttaagcaattctcctactgaatttgttgaatcgagaagccttatgttacttttatcagtgtgacagtggcatccaatcaattttcatcccccttaaaacacaagctcttttttctttgtgcgaaccacctccaagtcataaatttcaatttgaggtgtttgtctgcccttatattcatttacccttgccttaccaacaacattaagtattaaagttccatttgattgagtaagtttctcaaagtattctgtatcacttttaaagcgtatgtattcaatatctccatgtttaaacttgactgttgtcttgttctttttcccgatgtgttcaatttgatcaacatcaacttctagttctgttattgctactaatggttcttcgaccttatagccccaataatctttatagctatacagcttaattaaaaattcctttctaagttgattagctggtatctcaaaatcaacattttgaacatcttcttcaatatctatgtctttaaatttttcattcagcactttgttcaccagaattaagttctgtcgtttaattgcaaaaccagctgcatttgggtgaccttcaacaaactcaaacaatccggtatccataagcactttcttaaaatcctttatgaatcctttgtcatacccacgtatagagccactcaagatatctttacctttttcgggatcgtttctggctaacaagaccggctttttatattcttctgcaagctgattggccaccagtccagttagacttttatctagaattccttcaatgtaaacaatgagtactttattcgctgttaaacttttctcctctattctatttttaatttccgctccagctgcatctgcaatccgtttctgctttgcttttagatttcctagaattctaactgtgtcatcatgtattgacacaagctctgtttcactttgcccacgttttttgtagggaaccttttctttagaaagaaggaatgctctcatcatttgatctttttcttcactgcttccaaccctaatggcagcgttaattaaagggttaataaagaactgtgtattctgtatgttcttatcgcctttggttgaaaaatcttgcttcttaaacagcttctttaataatggatgcttaattttcttcaagccttcattcataaaatacctggtttcaaggtttcttgaatcagccgaatcagcaatgttaccaatagatacaaggtctaagaattgttcggcttcatttttatttagcttttcatcaactgcctggcaaaatttataggccattcctgcacctgttagagttttattcgaataattaggtgaaagttgattatttactacgatcgcatgttcagactctcgttcacattcatggtgatcaataacaattatttctgtgcctctcttattaagagcttcatgttcctcaaattgacttgaacctgcgtctgggattatgactaagtcaacatcatcaggaactgtattaataaaaatcccatgttccttcccatcttgaattctgtaatgtatatttgctttcggacaaatcttctttatataattgataatgattgaactggatgtgtacccatctacatcgctatccacttgaacaaatattttatttttattctctaaatgctttattaaacaatcagatgctttatcaatgttatcgagttttgaaaaatgaatgactgagctctggttcacatcaataaagctcttcggattttcaatccctctgttttttaaaattgtcgataatggattgaaattataatcattgttgccaatgagcttataagccactaaattcctccttcattcgtattgatttcaatttttcttctcatcaactcctctaaaacgtcttttcccttatcagctggactgtctttataatccaacatattttcaaaatcccataaaacatacacacgaacatacggcgtaaattttgctgcaagcttcaagatttttttctgatactcaagcagtttacgttgatacatttccaccgtttcatggtctttcggcggccggtatttatcgagagcaataaacacttcttccactccaagagaaagtaagatatcacggtgaaaatttgaaatgttgtttgaacagactgcacatgtgaaatttgcttcaccataaaagtcctggcattttaaaacagacttttctgattcaaaaattaaggcttttttaaacctttcaattgaatcttttgttttatgtaatccatataaattcatcatggtctgatgattatacagggtgttcccaacttttaaaggcatatatttatagccggcatcaacttcctctttaataagagatcgtctacgtatgccaatcaatctattatttaaatctcgatgtggaatggttataccttctgtgtagcttctaaaatagtagccaatttcaaagtcatttaatgtttgcatggtgattccctcgtccagccacatttgatgaggataaggcataaacacatctaaaacagtttcattgaagctgggaagctcaatgtctatctttttcttcttattgaacttccccatccattcccagtcatcaattaaatcattgttcgtgaatgtctccctattaccaaagccaaatgttctcccagctatctttgcaacatactcaatcgcttgattgaaaggtatattgatccctttttgactttttgctcgtataacaagctcaaagacatcgaatgtgtctccacattctgtatagcaatgaaattgctttgcttcgtgataataatacagcttgtagcttccaccagaagtgttatggcaaacggttctgtatattgggtttccttgttgatcccattgattattttcgctacccaattcttttaatattttatgtatctcctcaagcgtaagactttcttttattctgtccttatcatatttcaaagggtgctacaccccttatcctgctttaatattcaatttttcaactgtaattaattcattatcaatatttgtggtaaaacaatcttccgttctcatgatatccatgtttatgtatgtgaaaatcttcagcttatcatgcttattcccacgattcttaaatacatggacaacaaagttaggcatcttgtatccaaacccattcttcattatgtctgcagcagcttccttctcttttttgcttaatggaagaataatcatcgctacgtcagttttatctgcaattgccttacttcctcttaaataattagcatcaatttgcagaccttttagccaagcgtccttccattcaccgttcaactgcgttgcactcatcataaaaacatcatatttattacatagggcctttaacttatctgccatgagcaataaaatttggtcttctcttaagcttattccactgtttctactcatttctgaaaaaatggttacagaggaatggatataatcaaaataaatatacccaacattgtattttctaacgtttttctcgatagtctcttctatttctttgatattgaaatccggcaaatgttcaaaccaaataggtgattcctctaatatatctgccgcctttctaattctttcttcttcagactctgtagtggaattttgaagtattttctcttctggtacacctgagatatacgctattgctatactttgcagttcctcaggtaccatttccgttgaaattacagatgcgttctctctaaaaaggttatcttcccattgtttttctttgatattgtaaatttgggttgcgcctaagaagcaggcatctgcaaccatgtttcttgtcttacctcctccagtggtacccgatctcaaatagaactttttccttcgagatcccctaaaaatagaagtttgaatttcactgttcaaaggtactccaatatctggtgagagctttaacctatctaaaaactgatgagcaccctctccagcttgaatacccttgctttgactgtttgttttgaatttatcttttacttcaataatcttcatttcataatgggaaagtatttcttctattgacttcttatcaaagcgttcctgcatagcttcttgctctctaggatcaattattgtatgatcgtatatttctctaacgtcaaaccctagtccatgcatttccctaattaaactaaacttttttaaacggttataataatactcaaagttttcgacttcggccaaattctgtattgtatgaatataatttataccgtcattgtcattgaaaactttatactgaattccatagttttttagatatccatcaatctctacttcattaataacctctgtgccttgattaaataagttacacattgcagcaaagagaattgaatgaaatctttcgggaaagtcggcctttgataggttgtatccgttactttcagataagagcgagggttcctttaatatgctccccaacacttgtataattgcttttttgtcttgtagcaaatggactctccttcctataatgttgagatgtcaacaagtccccttttctttcgcaatcccttttttataattaaagtgatttcttctcttttgtgattctttgggtcttcagctgatttttgtattgccttttgttttatgtaatgtcgcttggcctcgtcatatacaaaagggacaattccaatgccatcaccttctcttggatgattcgccagtgtttcataaaagtacttaagcgcaagctcgattccttttagcttataaccataatcctcttgaaactctttgatctgttttagcatcatacctgtcggagatgcaagaccatataagttgcatatgtattgaagtaactcttttcgatggtctgcctcttgtctccacgtgttgaagcactgttcatggtagtatctttttttataaggaatcgctaaatctttatctaatttagtctcacaatatggacatttgacttgtcttcccaaataatcacccctattaaggaggagggaacaatccccccagtttatttagatagaagatcttttaggtcatccaaaattacagacataacgtttacttgtttgcggctgcattcagtcacttttactcccttgcctaaatgtttctctgtaatctgattaacctcttctagtcgtccttcttcattgagcttaattccaacttctttaatttgctccatcaaagagtcataatcaagctcatctgaagcattgttttgtttttgctcttcatatgtaacagcaacaataccttctgcttcttcctgtctttcgactgcctcgataatggccttctccaggttctctgcagtgaactcaggaaggtatgtatcaatgtaatcgaaacggctgcgtgcaaagtgctcatctgtttcagccaaccaagcacttgatttgataacctttctgtcttcatcaacaccattagaacttagataaagtacaatatcactgttatcaataacaggggccaatacacgtttatcacccttaggataaacctttccttttttgtcctctgcagcatgagcaataaagattacggtaaaccctacaccaattaatttattgatttcttcccaaacttctgtttcatactctttccaaagaccaaacccatcgtttccatctttaatccgttctacatcatattgctcacaaacatatctggttgcatatttagcaaatgcatctacttcatcaacaataattgtctgatacgtttcttttgccttttctgcatttttggttaactgtttattaaccttcttaaaatccgcccagctattaatagccataaatttaacgcctgcgatggcattcaaacctttttcaaatggcaagtataaaggcttcttcattcgtgtgctttgttttgtcttacccaagttgttagaaccatagattgtaattacttttccttctaaaccttttgcgactactgaaacttgaggattgaaaatatcgattgccatttaagctctcctttaattatgatttggggtgagtcgaagcacaccccgagttatgtattttcagttaagttattttatttttacccattaaaaagggaggtcatcatctgaaatttcaaccggctttgaaggcttgttattaggagcgcttccgccaaacccagacttattattattctcattgccaccttcattcttaagctcatctaggtaaatctctctttcagtcagcgcttttttaattgcatctgcattaaaagcattcttgctatcctcgtcatatggatcattgccacctgtaattaggtactctcttttcgaattaatagtgatttctttcttgtcttcgccaaatgctgctgttttggtcgttactttttgctctttaaagttaataatttttccaaaaacgttaaccgtagaccctttttcataattattttcaacgtattgagacccttcttttgtgactacaaattcaaacggaattactttcccaccatataaaggaatataaccatttaaattaactctgcccgtttcttcaccttttactttttcttcggttacattctttacaaacagctcaacatcaaattctgctcttggattgaattcttcattggcgtccagtctatttacaaagttagtcgttaactgtggatacgcctttaaaatcccttgagagtaatattcattcaatccaatctttccttgggtaattctcactttgtcagcttcatctctcccatgttctgcaatggacttatattcactgataatggtttgataaccttttgcaatagcattatctgtgccatcagctttcttatattttgaaaagccttttactgtatgcacttcatttggtgcaacctcaatatctagttcaatatttagccctttaccacttttccactcagtgtgttttacctcagcaagtatcccctcaatagttacaacatttgatgcttcacgtaatactgttttattttctgccatgtaaataatcaacctctttcttttaattgttaattttatttttattcttaaaatgcctataatgagacttgctactaaacttacaatccttgataccaagtagcttatttaattctatgtatctcttttttggaaagtcccaaggttcaggatcaccttttacattttcaatccttattactgttccatgccggattgtgatctttaggtttccatatgagtatgttttagaaaaaagtcctctcttaattcctcttggtttaaattcctttaccaacatcacattcctggttaattttcttcttgcttggtcttcgtcaatgtcgtaattcctttttacatcatttttgtaggtatgtaaggctactgcagatactttcagtatctttaattcctttttcatcactttcctcctttctctctttgggataacttaatcttacatcaccaaaacgaattggtcaataactattttatttttattctaaaaagttttaaaaagagttgagctgcagataacagctcgacagagtgcttaactttagctgggaaagttgttaacccttttaaggtggttatccatatgttttaatatatgaagtttttcattaaaattcatatattcttctttagtaattttctttgctaattgatattgacgtgaatctaattgaactttatgtccgagtttatctttaataattacgtgtttaacattaaaaatcttgtatacttcataaaaggagttcatatctagatcatcatatttgtttgcaccattgccactttctttaattctgttaccatcattgtctatacgtcgtgtatcgattggcttcacaaaatcacccaatcgaggtcttctattaagagtttgaaagtaaaccgattcaccgtgctcgttttttgctgttaagaagttcatttgcttctcctttatcgacgatattttttagaatacctcataaaagaagagccgcttaaatagcaactcaaaatgtttatcttattagcctcccactctaacttccataactcagcctccaatagaccttatctgtatatcagagcgcttaaagaaggctatgtggttgatcagccaattgaatttaatgaagcaattgtgcggttctatgatggtgaagaacttgctgtgatccataagactactgggaagagatacaatgtgaatgttaaaatgaaaaaacttcctgacggttttacgctgcagacaatgaacatgtggtcttggagtgaggttatttgattattcaaactcctttgtaaatggtataattgaattaataaaggagtggtattatgttcatcaatcaatcgttcagcagaccaaggatatggcgtttatttagagaatacaaacaaggtacgtctcgtaagaaacgatgtgcgcggaattggtggcaagttattatcccacccatattgcacagataaagcaaagaatacaaccttaatttataacacatatgacagtggaacgctgaagactgcagaaggagatattgtggtctaaataaaactgtagttttaacaagtttaggagatggatatatggccaatattttaaccaaagaacaagatgaagcaatccggtatttcaagaacaagctgaacatatctgaaaaactgtacatatccctgattaattttaatctgcttagagataaacacgaagactttggtaataaattatatgagctttataagacagacatgatctcattatcctttaatatatgttctgaaccgccagtcagttggatggctatcaatgatttacagaaataaatctgattttcactaatttggcaactatatttatcaggagtgcctttaattgcaacattcctaggctcatgaatttcatttcgatgtagtgagacagaagagtctttatcccaaaagatgccgtacccacttccacttaacaacaagtcatttccctttaaacgaactgactgagacctttcgcaataaattccaccatatacattagcaaactcattattaacgagactgactcggctagagtccattatctttgcagcatatgatgagctcgttccttttcctttggtattcacaaccttaatatcatttgagttcctaacctggacttggacacaatcactgttttctatcctgttgtccgtaattaaaaagtcctctgcttgatgtgttgcaatagggcatgcttttattttttcaaaagtattatttgatactgtgccaccctttcctcttacacaaatgcccacttcaaagccactaatcgtattgccatcaatttgaactctgtttccagactcagtacttgaaacacctaccgaatcaatcccatatgtcttaatttccttttcattgatgatcttgttatttttgatactgacatccgtgctatatccataggaaataacatggtcgctgtagtttccttcaataattaccttgccgcttgtgtgagctgtaacggatccacgtccattatttttaaacctgcagtttcgcacagttaatttataggggtgatcgtatttaattccgttttctccaaagccctctaaatcaattcctaattgtggcccaattgtatctcccccagcttcttctatatcacagtcatcgacaagaagaccttcacaaccattggtagccagattatttcttcttcctcttaaaagcgtacactttcgaacggttacattctttgagggcgtatatgttcctgaagtgttcatcattccatcagccgctatccaaatgttgtctccaatacagtcagaaacttgtacattttcaattagcacattgctacttccattaacatggataccaaagccccattcatgcgtcttcttaattgaggtaatttttgaataatcatgctcatgtcgatccccaataatttgaccgccacgaatcgtaacattacttgcttggccgatataaaaacaggagtaaccctgataatcatttggctgcactttaaatatagcctctggatgaagtattagctcaatattcgaaggaacattgatacctccaccgaattcaggtaaccgctttgacgtattcactgcatcaattaggtagataccttttggaacatatactttatagaatgattttgagcatgcatactctaaagctcggtttaatccttctgttgtttcaattgcatttgaccctttatcatcaattccccaatccagagcatcaacaaaatagtataagggctgttgcatgttcatgttgtcaaacccttcccttctacattttcattgagaaaccctgatagagtgtcaatgaagttataaaaagtctcatttcttgtaccagagcgtcctttcagagaaaaggtgttgaacattgatttgcgtagtccagtgctcaattccagttgaatgctctttcctgttttatttttattggccacgttatttggactgctaccggatagcctcgtaccctcatctagaagctctgcagggtagccggcattatttaatgtacttgttatcgcttcagctttgtcccggtctgtgccgccaactaaaacatgttgatcattacttgcgtagccgtgaagtgacagtgtgaactcatgttccttcaacatttcaagtgcttgtggttcatcaaaattcgtactggttaaatgcaaatcaaaggctcctggtgtctttaaagcttcaaaaagatatgtagagtatgtttcgcttaattccttagcaagctcgcttgttcccccttctatgccacctccatggggagcaagaattaatacatccgtgtcttgctcttttgaaaatacgctaaaattgaacggtgattcattcgctttaagctcttcaaagttccgatacttgtcctctgctaaaatactcactggattcaggaatgagaccagagctgtcaccaagaatggaaaagtcttcttaactatgttatactttaatagcttcacttcgcggtgaggtgggcagattagagtgtaccatccaaagtctctcttctctgctcctttagtcttttttagcaattccactattctgtttttaatcttcaattaaataaacactccttttatttttataaacttcagatagctgaaataaattacatctcaatcacctccttttaagttaaaaatcacttttgacgcacgcaatctcaaaattttgttttaaatttattgcatactacaccatagtatttaaaatattgctgatgattagctttttccaataaagttatgaactcatctccatgttgttttctcgctgaggaatgtcttaggtcgacaatgtttatttcttgtgcttttacactatgaataaactgttttacttgattaatcaatcttttgggaactgttccgtcttcaatcatcaattcaagctctatcaaagtacgatttgttctatctatattgcttcactccattcctctataaaatatcgtttttatttagactctataagctcagaatcttcgtaaatgttgccgatgacttctaaatcaacatgagctacaaatacagtagtcaagcctcgctttattcgcttgaatctaaaacctggcacctcttttgtccaatagatcccgtctgaagcatgttcagccacttcttcctgccataaaacttctaatagctcatttgaattatcacggtggttccttacaatgtctccctcataaatctcccggccgtttttgtcctttaatccggtgtattgtcgaaccgatttcaaacttttatcagcaaacgaaaattcatcaccgtctttatctgtaacgtaatctatttttccgttatcaaaagaaatgtcatgaacatcaataatttcttcgtaactgtctatacctgcccaatgcatattagaacccaaattgcttaatgcatgtttaactaccaacgcctgaaatttaatatctctcattctctccacctcctgttattgtctccactcaaaaccgatattaacgtttgcttgtttaggtctgataacttcaactgtgctacctctgttagacagcctactttttaattccttcatatccttgtatggcgctatttgcaaggtgctcagatcgataagaataacttcatgtttatctttagcggcatactctctgtctagtgttctaacaatgtatacatcagcatcatctattttaatgaagtacccgtcctctaaatctttcacctttggcttatctgctttgttctttctaatctttaaattgatcgccattattctcacatccacttattttatttttatcaaataaatcaattatgtaggcttcgtacatctcatcccaataaggatctgttcttgctatgtatttctttactcttccattctccacaatcttaaaggtttgccccttttcaatatccgtgaacttcttctttgtccatatccctctgatcaacactacaacttcttttacctcaactgtttgccgctgcatcacattcctcctttttgattttcgtgtatcaagcctgtacaatattcaaaaaccctaaaggatgatgaacatgtgcggcaggttcactttattctctgagtttgacgacattatcgaacagttcaatatagatcaatttttgtctgaaaacgaataccatccaagctataacgttgctccttcacaaaacatcctgacaatcattaatgatggatcaaacaaccgtatgggtaagcttagatggggtcttatccctccttgggccaaagatgaaaagatcggctataaaatgatcaatgctcgagctgagacattggccgagaaacccagctttcgaaagccactcgtaagcaaacgttgcatcatccctgcggacagtttttatgaatggaaacgactcgatccgaagactaagattcctatgcggattaagcttaaatcatccaatctctttgcatttgccggcttatatgaaaagtggaatacgctagaaggcaatccgctatacacctgcacaatcattactacaaagcccaatgagcttatggaggacatacatgatcgtatgccggttatccttactgatgagaacgaaaaggaatggctaaaccccaaaaacaccgatcctgattatcttcaaagcttactgcttccgtatgatgctgatgacatggaagcttatcaagtttcatccttagttaactcgcctaaaaacaactcaccggagctcattgaatcccattaagtaccacagtcattttgctttatatatcaccttcgcttagctattatgttctaagtaggaggtgatattttgtttgtatcgccaatgttattgcattcaatcaaagaaccatttgatgacgatgattatattaccgagctgaagtttgatggaattagactgatcctctccaagtttaatgatcagataaagctttatactcgtcacaacaatgaagtaacaagcaagttcccagaactgttggatattgatatacccaatggaactgttttagacggtgaaatcattgtagctgccccaggcggtgctcctgattttgaagctgtaatggaacgctttatgtctaagaaatcagctcataaggtggtttattgtgtattcgatgtaatctatattgacgggtattcaatcgctaataagccgctcactgaacgtaagagcatgcttttagacctaaaccttgaccacgaaaatgtctttgtaattgaaggcctgcaaggaaacggattagcttactttaatctggccaaagaaaagaatcttgaaggaatcgtactaaagaaagctaactccccttatgaaatcaataaacgttcccatagctggctgaaagtgattaattatgattacacagatgtgcttatcactggctacaccaaagaggatataaagtttcttctgtcttatcctgatggtacaacagctggatttatggaattcatgccgaatgcggaacgaagtaagttccactctatgaaacaagtaaagtctgaatctgatgaatatgtatttgtagaaccgatcttatgtaaggttaaacacagatttaagactaagcatggcaaactccgtataccttcctttgaatcctggagagtctaacctctccgttacataattccttaatgtctctttcttaacaaaattcaaaatctattacattaacactttaagttagttctattccatctcaatccacttataatatttccctatatgacaatcaaagcgccaaccatcctcaatgactttcgtatgactattcttatatttcgagtgatttaataacaccctaggagaaaacattattctctgccaattaaataattctttcatttttcatacccctttccttgtgaattttcacttttgataacaatgttatctttacagttcgttcaattaaatattctgcattgcagtaatcgcattttactctaaattcaagagatggctcataaacaatggtttctccacaaatctcacaaggaaaaacatcttcattgattctccccataaataaatcacatcctttaaaataactattttattttgatcccataataatcaccaaatattttagcccacaaaatcatttagaatattctcattcattctcctccatctccatatccgctatgagaactacttccgaataacccgagggaaacgactaatgctgttataaacgacgacaatataaggggaagcaaaaatactgccaagccggtatagttagactcaaacgttataagctgtgtgatcgaatatgcgaaaaagaaaacatacaatccatatataatccaaaaccgcatttattcactctccaatcgttttaatgcttcactgttttcgccaatagtttcgttaatcaataatctgcgagctttctttatcgtagttatttggaatgtgcaatcgtctcttccatacatctcacaggtaacaacataatctctaaatagatcgttcatatactccatgtcaccacaaccatatagtttgccgtttagaaagcacgcatatatttgcgccattgactttcctccatatcacctatggctatcaccgccatttgattgtgtttctgtcatttattccatctcaatttttttgaattcttttttgatttttctattgcttttcactcttttattaatagaggcgttgtcttacccatgccatctaaaagagaaaggacatttttgtctcggaggtgaaaggtaatgaaatttctaatggatcttttcacaaattggacttttgataaagtcatggattacatgctagctgctgtaatttggtttgtattcaagtccaaatcaaagcagaatgagtatcctgataactttaaggaaagaaggcgttatagagattgatattctctctatgatcgttatctatatggttactgctttagatagcgatcttctagtggtttaatttaaattcaacacccaaaaagtcacatagctcttccttaaaatccggttctccaaatgttccattcaacaatctgtgttctaaaacattgagagtaacctcttcaggttcccactgatcttctaaaccgtggcatgaacagtgggaaccattaacctcgaacaatttccctctctcttcaaatagaacccatgcgtgcccttcacaaatgtcaccatcataagaggcaaacagaatgtttacatcagtttctttttcttcaaagtctgacaaaacgtcaaccttttcttttccttcccaatcgttcagaagtactgatttttgcttaatgatttcttcaaattttttcattgtccctaactcccccatttcattttaaaaactatcttttatttagaccttctcataagtctgatgaaatatgtcaggtttacaaggataaaactcaccttggactcctttaataacaaaatcattaggcgaaacgatcatactgccttctaaagtttgtatatgacgcattgttgtaagtaaatcatgccagataccaactacatcaccgcagaattcccgtaattcatcataagaatcttgtgatccgtcatattggatagcatcaacttcaactggttttttatatttcacttcccacctcttcctttaaaatcacgattttatgtagactaaacctttttcttgctgtcatgcgttcacacttttgggtaagatactaatctgttaacattaataactcatcaactttataattgtattcaccgtattcacccgagctccatttaacacctacagagccttgatttgtcacccacaatataattcccatttccccattttcatgccatcttacttgctgccctttctgataaccaagcatgtttccacccctttcttaaaaagcattttaatttaactttaatgtgtattgccttgagaaaatcccctttaattggtaaactcatacctaacttacatacgagtgggtgattccttgaataaaacaatcggtattactggattaatcatcagcatagtagtacaatcattttcggccgatgattcgctaacccaaaagattgctacgggtttgttatttgtatcaataattatctataattttgaacatgctaaagattattctataaagtcacttgtaattttaggtgtttcctttattgtttttatgctagggatttataaaatcctctctattaccagcgattactttgaaaagcttaatgtgaattttggatacatcctcttatttgaaatagcattgattattgcattagtgtcgattgcagtaaacgtaatgaagtacattgcgaatcggttaaagaaatcacctgatggtaaagagctttgactctttgccgtttttaagctaaatacttcttcttatgtggtcttctatgtatgaaatcaaatgcgatatcaacttttgccggttccttctcctctgctactcgttccgtaacaacaatcagttgcccattttcctggtgttcaatgctatgaactgaatacccttttgaagcgtaatattcaccaataatctcatcaacgtggttgctaagcagattcctttttatcaccctcataacctccacttattttatttttatcctttaaatatttatatgtattccatccacagccatcaaatatgcttatatccgctccaagatgccatttaaaccaaactaagttaaaccaggctgtatcaactatgtacttgaggtaatcgataccctttgccctccattcttttatgcaaaattatataattctttaatcgttcatttgcaatatcacaatactctttactaatttctgttcctatgtatttacggttatttaaagctgccatctttgcagttgttccacttcccataaacggatcaaatactatgtctccttcatttgaccaagagagaatgtgatcttcagcaagcttttctggaaatattgccggatgttgaaaagcgatcttgtctagtgttgatttttgatgaccgttcggtatcctccaaatgttgaacctcacaccgaactcctttagtaagttctgtttatgatgtcgtactttttcgccgtccatttttctgtaatgtccttttatgtgtttcttgccgttgtaccatttatttttcctgtctgctaatagattgattgtttttggcttgcctttcgaaaaaataaacatatactcaaaaatctgataatatctattcttatctggaaagctgatactgtctttttcataaatcattgtgtcatgtaggttaaagcccaactctttaaagtataaagcttgtctaaaacttgaccctgtctcggaacctttatgtgttttatcccctactacccaaacaacgactccgccctcttttgtcaccctatacaattcttgagcagtttcctcaaagttaaatgaatatccattgtaattccttaggtcatcataaggaggagaagtcactgttaagtcgatagtgcaatcaccaatattctctttcatgaattgtacgcaatcattattatgtattttgtttagttccaataaataccctcctttagttttcagatgaaataatccttttacacaaatattaatgtaggctccttgtcctcttcatatcgttcgtatccaataaaataatgatcgtagtccttttgaatatatgatgaaatccagtcgatgaatttttcaatctcatcatcgtagttttttaaattacatctaatacttacataacaaccaccaacagcgtcattttcaattttgctatgggttttcccatcgaaataataactatctgattgaagcatccatttccatctagtatcttcagaaaacagattatgttctggcaactcacttggatgttcatctctttgaccagtcataaactctaaaatttcaattattgatcttggtgtttcctcaataagcttaaaagcacaaaccaattcagtatacattcccattaatatatctccctctctttaaaacagtctttttattgaaaatatttatctgatgtgcgggccatgtcttccccgcctaaatagttttttatttcatttaagctataaatgaccttatcgaatttatccctaatgtgcggtgcatattcaactgatgaatcagacatccctaattcctttagatttgtgtctaattctttaaagtaaccttgtaactttacgttcactgaaaactctcctttttttgttattatttaatctcaacaattagactgtctggaaaattcttcacatcaagtgcatttacatgacagtagcctacatagccttctttatctacatacttataaaagaagttttccccattattgatgatgactttaccatgatgtgtatactccatctctgaccccttataccaaatcactttaacttcagttcctggtttgattttatctaggtcaaatattgttatttcttttaacaaacgacaacctcctatatattttattccttctccccagaaagctccttgattaacatctgtccaagctcatcactgatatatctccagtcagccccttcaggcgttctaataccaagagaaaaaccgccacacaaggtatcttcagccaaccttaaaactccatcatttgttttaagcagctcatgtttaaccatccctttaatcatttctcctcttcctctctctttaaaattttacttttatccaaactgctttctccaagggacgttgcccacaacactgtgatcaagcatttcttcgcaacttttacacagggttgattttgttattgtcatatggaaggagtcccacttaccacaacagtgacacgtattctcaaatgctgctgattccttctgtttttttctttcagagccgttgccagttaacaataggccgttactataaaggtcgttctgtcttacttctgcttctacactccatgggtatattcgcttctttaagtgcctttgcactaacgactcgcttcggctatttccaatcttcatgaactctctatttgcagtaaggtcaactgttcttttcatcacttcggccttttgaacagctttttaaaccaattttctttttcattaaccattacaaatccgggattattcatcctaaacccatttcctgtcttgtccatgttgtttaactgcttcttcaattgctcaatatcttggggtgtattgatggtcattgcaatatttgattcttttacttcctgcactttggaaatcatcttatctaaagtgagatcacattactcatcttcgcagtcgcctatgaaataaaaacgttcaattaaagtaccactcgactcatcttgaaaagtgccgaataaaattggatccttatctctccgttcttttttgatctgcctttcaaccttccccgtataatctgtaaacaccacataaaaccgatccaatttgtctttcactttgttgtatttaatgattacatcatcagggatttcacgttcgtaattttcaagctcaataattttgacagtatcttttgcaatgttatctatgtattcttcaatgtcatatcgataaacaaacgtatcaatgccaagctttacaatctcgcgttctttttcaattgattctaagtggaatatcagtttctttgcagctttaatttgattagtttgcttatacttattgagtaaccagcaattgtcgtaatatctttgaagttctttgtctgtaaccttatttttctttgatttaatcatgtcaaaatattgatttggttgtaaaacttccatcttttcactcctttacttaatctaattccctcatgtcctcccgctgctcaatataacttttaaagtcctcccattccctatcgatttctttaatattcctagcaatatagctttctgcaatgtctggatcaaccaacttttgaagagacagctgatacataaattcaatctttgacactgtttctagaaatgactgggcataactttttgctctatttaagcgatattgactcattccatgttttgattccattattattctcactccttttaatcacattaaaatgcatcttttaatcacttctttgcagcatagctctcaaagaattcttcaactgatcttagataacggtatttatttggatcttctggatttctgaatcttttcgatagcaccaatgaccaattaaacatcaatggggaaaaccttgcccatttgctaaagcttaactgaaggcctttccattctctccccgctaattctgctaattctagaatttgatcttcttttagattcacttcctcttcaaacatcacttgaatttcttcgtatggcttatgcccaaaacaacaatgacgtgttttcaaaccaaacttgaaatttaagatatcaattaaattaatcatttgtgtatcaagttcatcatatggtataccatttgcaatgaatttttctctttgatttgatttcacattattccttaataacaggttagacctcttactcattccgcgccctcccaatgtccatgccttctcatgatgtccgttacctcatcgatatagggttcatcccggttgataacgacataatcattaagtgctttcccttcggtttctctacacaaattgatcctgtcaatgaatatcccaagaaaaagttgttcctcaaaagttaaatgatctttgacgtcatccattttcaaaacgatgaacttactcattctgaatcacctacaatctgtagatttttatagtgagctacatgtccgcaggggttctcccaaatatgaacttgtccgaagaatccgtcctcagcgtgttgcatcagctgtggattccccatttcctcgccacaagtaggacattcccaaagtgcgttcatttctttaaacccgatcatgaaacctttggaatcgcgggcgggaatcgttacttttttttgcattcattccccatcaccttcccatgtagcaggaaactgaccgtttaagaccttacttaccactccgaaaggatcgtcctctttatcggtgaatgtagcaagcaaccttctgaaattgtcattctcgtatttaagtcgctgaatctcttcctgagcctgccgaaactgaatgaccgtgacttcctgctggcgcttgtgttcctcaatagtagcctgctgctttttcataaaaccgatcattatgtctttgacataactttgctcgatgatgtaacaaggccctgcgtttaaatcaaatggcttcaactcttcttcagaagctaaatgccacaatgacaagtcacatataatttcctttaatttatccatgctcttcctccttatttcaatctcaataaaacttacattttatttttattcttaaaataaccgtgctgatttacaacatctccaagtatgtattgtatttcctctaaattgtctttaacgaaatctagatctccaattgccattctgatttcattattctctatgctgcgtaaagacctttcacatgatactaagagctttgtatatttccttaaaaccatagttcttatttgatcgttaattggttcattaatcaataattaaagctatctcctttcctgattctaatttgattatataacctcaaccatatgttgtaaatacttattttatttttactctaaataattttaaaaagatcagctttactcatactgtaaagctgctgtcttcataaacgtcttcatgccgtccagtttccaaagagtttcatttattttatctctaaattctaaaactgaagcatgatccattctaatcctcaaacaatccccattgtttttaaagataatgtctatgtagtactctccactttgtatgttcttagaaccaacactcatggaaactgatctcataatgtctttcaagtcaatttcaagattaaaatccattgtatgctccagtctgactaaaaagtcaccaattttttatgtctcatgatgactggcaagatgtgtatgtgagtttattttattgataacagttgagaagatttatagccatcattttcaaacgaatcgtctatttcttcggcataagaggttgttatttcagcatcctctgtacacatgatgtctacatcaaatagtgcctcatatttttcttgatctttttgaagaaaccccattttccctgttttatttcttaatttctttttaattgattgatatgcgaacaaaagtgcttcctcttcattcttggcttttattctgccgaaaaaaggaatgcacagctccccttgaatgaaataatccttttctgacatacgtttccctctctctggtagcaattaaccgaacttacgttccctttttgttaacttaattataaccttttacctagttagtggcaaatcttttttctttcatttaaaaacttggaaagaattgatatagtatgataagcaatactataacaggaggttgtccgatgcttgaggttgaaatcggacaatgtttgatttccattctcctcgaaagtaaaggaatgtcattaggagaactttcaaagcgaacaggcattagtacgcaaagattaagtgactatgcaaacggctttagaccttctatgaatataaaaacagcgaaaatcattgctattgcccttaactgttcaattgaagatctctatgaatggaaaatcaaacattgactttatcgctagggagtttggcctagcgaacctccttgtaccctttttagggtatagaactattttactgcatatgtacaaatttgtctctgtctaactttgtcgaattctgaaaaatgtgaacaaaatcctgatatttttcgaaaaaatatcacgagtttatccgcacgtgttttatttttactctaaaagttatgtaaagataatccctgcaacagggattaagaattattctcaattacttcagacttgatacaatatttttctaagttatccatattcactactttcctcagtgattgtgaattaaactccgcgtcttcattcagaaacccgtattgtcgagttatttttttataatcaggtacttttaattcacccttctctttgtatatctcatacgccatgttgagctttcctgagttgatgagattcttgggtgaaaagaagggttcttctaaaaatttttgaaactgactaaaagatcggtgaactaaaaatttatcagctttcatactctgattagaactcttatattttagcctaaaaatgttttcgcttttaactaatgtagcaaatttgtttttaagtccactctctggcgaaccattgctaagatgatatgttgtttgatcattagcgcgcttaagcaactcataacatttatcgcttacagtaattattcttacaccatgtttatcatctaccagctttaccttgttatcatcaagtaaatcgtcacctgttaaattcagtaactctgaatgctgataaccatctataccttcataaatagcctgtatcatcgctttatcctgatcattaaccataaaatcaacatattcttctacttctttattggtgaatagtgtttttttgtttttatctataaactgctttaagtcaccatcctgtatctgatacactttgttgatgttactgtttgccaagccattttccattgcccatgttgtgtattgtccaattacagctcttgctcctcttagtgaatctatagatttactatctaaatctaaaaataacgtacgcagctcttccaaagaaaaattaaatatgtctttttgaagtattttttctgtagctgagaaatcccttagccttagccaatagtggtttcttgttgcttcactttcgtatttctctaaaaacttttccttcaattcagcattatacatttcactcatattaaattctcctttaggctttaaacaacagcaatttcatcataaaatattcgcttaagtttcttcttcataacattctttagttgattttcattattttgtcttcctaattcttcaaacactcttccgcttttactaaagtcaatcgtattaaggatattttcaagcttgtttagttctacattgttttccttcatcttcttggccaaataaacataaccgtaaaacattacgttatggttaatgtatgattgctttctaatggacgataaatcatcttcaagaaattcatctgggaaggcataaaaaaggttatcgaaaaagtctaccaagtatttcgcaattttcaacgcatcttttcgagatttcaactcaaatgcatcgtctatagcttccgataaagtataatatgtcacaagaaaattgctatcgataccaatttcactttgtgggcttattttatttttaagttcacttttaaatttcagctgctcgacaacggttgaagaataccgtttttgtcccaattcttcaattctggatttttcaactgggtttatggtattcatttgagcaaagtgaaccttagccttttcttcatcgtaattgagcacatttaaaatgaatggttgatctaattcagggacttcagcaatggccttaacaatacctgaaattcgatgatatccatcaagagcatctaataaggttcctcgtgttacagtgagggattggtcgcttggatcatattcaacttcttcatcaccatcagatgttccaagacgagcgttaaaagttaacattgatacaattaaatcgcctttaataaacaattctttgatctcatcaactgatttagggtttgttttaggtacaggaataaggctacccttaatgtactttccttcacgctgagtgttgtaattgtactgcaggatggagctattatataactcactcagttctttggcagtaatggaagtgacatagttatcctctttaattttaatcacatttttaaacttgtatgggagcttaactacttcttcaccggcgaataccctcccaccttcaagctcttttgccaatctggttggaaaataatttgacggatctaaggcttgcgtcccaagaattgaatacatctcttttgaaacaatgtacacttctttttcgtttaaacgctgtacgttgttatcattattatttaaaatttcttggatataaccagggagtgccttgtatttgtccgccattgtggcttttaattccttcaccatattgggatcatttttaatatcattaagattttcctctatttcagtttttaacttataaagtttatccgttgtcaacaaaacttcagacacattatcacctcacataatcatattaaatttatcattattttcataagcaagtaaagcttttatatgattatttgtatcacttgttcaaaaacattttaagtttattctgtatatacatgtctgattttaaaaagaattctttatattgctctaaggtaacttcatctaaaaaggacatatcttctttttgatcaaccaaaacccctggatcttgagaataatccctttcattgtttaaataatgatcattcaaaacattgatattgctgtgaccagagaaagctgccacttttttaatatcaccattaacgctgtaagaaaagtttgttgcagtattgcgtaaactatgcggagttatctttctttctttgggaatacccataactctacatacgcgattccacatatcctgtattgaatcaactgttaacttatgaaataacagttcatgttccccatactcttgctttaacagcaacaactcttcataaaaagctgtggaaattccaactggcctagcctttttttgcttagtttttttaaagttgacgagataacattggtgcttttctgaataagtaatatcatcccacccaactctaagcacctctgatttacgccctccagtgcgtgcactaaacaaaataaacatctttttcattaatctgttctgacgctcagtagcatacgctacctcagcaaattcatcagcttcagatattccttcaaaagaacctgctgggttcttttctgttggaagaggcctaaaattaaatacagatgcatcacactcatgttcagattcaaggtacttaatcatacttttcagtgctgcaatcttattgttaattgttgaattggagttgcttttatttttagccaaatgggttcgataatcatacaggtcgcttttcttgatcgccaggtcactctcagttaaatattcaatatccttggcagcataatggttgaaaaactctcttatatgcctttcatacgtggctctagtattagacttttcaatttctccagtttctcgatccctgtttcttaaatctaattcatcaaaccacctatttatgttattgtatattgaataatcccttagtgttgacgctttcttttgagctcccataatgacacctcatatcatttttttcattaagtattgatcaaattcttgccatgcaacaatccattcattttcaccttgaatattactcagtagcattatattggcgttacagatttccatttgctttagcatgtcgtattctttaagagcgttaattaagatgtctgtattcattttatcacacctaatttatttttattctataataaaatttagtttaggacatttaccctttcgtccttacagacgtttataattggcatccccgttaattcctcataaagctcctcttcgaatccaacccattcatcacttgtcgcttctcttcgtaggaactcattataagctactgctatctcaggctgctctaaaaactttaaaacgatcatatgctttttccaaactttagccttgttttcttctgtataatatttattattcattttatttttactccttaaatacattttattgaattcttttgttctttaatgaggttatattctttatgattttttctcattgtagttacattattaggtgtaaacacatctggatcctctaggtggagattgactcgtgtgaagttctttagttgttttatgtattgatattgtcttaatgatgtaatcttcaactcttccttttgagtggcacttgttgtttccattgtttcatctcccaacaacgttcatcttgtaacttcattatatatgttcccacaataatatgcaataattattttatttttactcacgacaaataacacatgccctttgtatgtgttaaaatgtctgctagtttgtctttaatcctcattaggatacctttgctttatattttgatctaatcatttctgcttcattttcaagatgattgtcttcctgggaaattacaagattaatagctgccatttcttcgtaacctttggccatatcctcataagaaagtgattgtccgaaatgctttttcattttaattcctccatgttcttgttttttatattatgaatttctggaacattctcttaaaattagaaaagacgcctgatccactggatcaaacgtctaaccattgattatgtagtatcctgttgtattattaagctccccgaattgcacttgctacagagatctcatcagaagctgatgccgtattaactgaatgttgacctgcaatgaatgaaattgctaatgctgctaaaatggctgtaccgaaaataattttcttcattaaattcacctcctttcaagtgctaaattctaaattaaatttagtagctccggatcacagcctaatttttcgagttctattatagtcaattggataaaatatttatcatctgattttttgaaatatgttattgatttataaaaatcagatttttgttttgatatcaaacctttataataaaaataaaatcctaattcattttcatcttgatccctatttgataagctttccaataattcgttagccttgtcgagattattattttttatgtaataaaaagccctaagctgctgatatttgatatcatctgattcatagttaacccatggattttccttgttccatacgttagctaggaagcaaagagcgccgtttagcatttctttatgggtatcattaagaacatacttctttgcctcaatatacgccagcatagcttcttcatagttttcgaaaattagggtatttcctatagtcagatgcgcaaaaaaacatattcggttcacattggactgcattattgcaatatttgaatgtttcctcgcttcgattaaattgttttcatttaagcttatattcgcttgtaacattgacactctacttttgtacgaatcttttataaatccttctggcaagctgctaaaatctaaaagtgttaaggtgcttttcatcaatccaaactcaccaatattcaagtatttatacatcagcattgcatctgagaaaaatgacatttctggggctttgcatcttccgcactctcttattgcttctggtattgagatttcgtttttataaagctttctatgtatgctgtagatgttgccccattcttgacttgtggtgttttttgagttgcttaaatttaaaataatcttgtctgttaacgtatcccattgattaatatctgagtattcaacagactgtcttgcgctttttttattgggatccagtgataagaagtaatcacttagaagctgctcttcattatcaggaaacaagcttttaacaatattaattaaaccgcctaagttgtccatttctttctctggggtgttgatgaatttgtaaaaaccattaaccttttcgtaccctgctatttttgagagtttcgctgcgagctggttgtctttttcacattcattcttaatcatctgcttaagattcattggttactccaccccttcccaactaatgttctcttgtttataatatacattagagttgtcagaattacaagtatttattttatttttattctaattattttttaaggaatacttatctgtttgaaattcgtattttatttaaaaaaagggggatcgcccccgacttttatttgtccagaataatttttgcttgtgaaaatttttggtttaaattcctgttttctttcatactatttaaaatgatttcttcatccaatcctatctttttcaggattaaaaatgttaatagtccattcattcttaaggaggcgtaatatttctcaactgctcgatggaaaaccttagttttgtttgttagatcatagtgagtaagatagtttctagtctcaacaagtccaaaaataaaactgtccctttttttattattacccgaaaggaagttttttgtatctgttgattgttgattaaataactcctttagtcgcttcataagattaacttcattaatatgctttaacttatttaagaaaaattgcttatggtcaactgaaacattagaattaataaactctcttactttttcagtttcaaatgttagttcttggttaaattctaagctggagcaatatcttctgtgaaatatctctaaacactgaatatttttaatgaatttggtttccacgaactctttctgatctttactgttcataaataaactaactattgtactcagcttttctctttcttgaaaccagttatttaacaaagtttcataattgtgtcttaccttattataatcaaacaagaaatttgtattcttctgtttaagggcttctctgtgatgttgaaagtatttatatttcaattgttttttatcttctgtcacgtttaatgtgatatttatatcgtagttaatgttgttcattagaatgtttataagtctaacctgatgatttacattctcatgaaaccatttcaaatctttcctttctgatgggattatattaaatccactaacatgctccatagatacacactgtccagatttttgattcttaatctttaccccactagtttcttgtactacaaaatctttgactgtaaccttgtttatgtttattctctcataatgtatttcatgtttttcaccattagagtcaaatatttgagtgaaggcgctcaaacccatccattctgttaaattcccagttgaaaactcagcagagtcaaatttttctggaaatgcctctgtgtaatctcctactaaaaagctcctaatttcataaactgaagtgggtattccaggtgatctaaagtttgattttcctattgcaagaacatcaagtttatacaattcgccatctactgatattccattgataacttttggagtgtcaccaatatcaataaagtcattaactaatgtacccattatctctaatgtgatttcttctggtttatatattaacgtacctggaacttgattttctttatctttatcaatccaccaatacccttgtacagaaaaaacatcaaaaatatctttatttactatgtttttcataactaaactccttttgcaattaatgattttaataagggttaatactcagaagggagcttgtttgttccttttaatcactcacttaagtcgtaaatacaactttaattgtttctctctttcaatttatttctctttaacatgattatttcatggccttactctacatttaaagccgcttccattcaacatactcaaatcgctgctgataaagttcttcaaggattgcggcccattcaacccagccgtccgcaacaatgcttttcttctctccatcctcaatccattcaatccagtacacctgaacaccccttaccgagtaataacttcaatctgtcttatagcagaagtgactttaaactctgtatgtagctcgtttgagatcactaaagcttctgacattgtagtaaacttagaagcgccatgaagccccttagatgacttataaccactaccatccaacttaaatgacctgaagtaatcattattttcaaattgaatgacaaaaaagttatcgattaccggcatgattatcccctcttcagcagcccaacaatttttatccctaatggcagaaatccaattagtatataaaacaccatgatatttattttattcttaaagaacaattcaatcatgttttgctccattcctggtgaaaaggaattaataagctcctgtttaaaatcctcatcgtaaacttgatcaacgaataaggctttaaatcccgtcaggaagccaacaccaagccagagtattaagaaatacgaaaatccaatcataaaaccctcctccttatatacatcgtctggtattatagtagagttaaatatcctatgtaggtgaatttgtatggaagagaaaaattttgagacaaatgggtatgatgtttctgtcatttacgattataaggagtaccctgatgttaagtatggtcgctgtgacaactgtgattacactctgtttaagagttcagtgaaaagtggcgtgtttttacgcgagtgtcgtagatgtgggatgaagaagagtatctaaacactcttcttcatttatttttaggcttgatttcaatttcaagatctaagccgtctagaattttgagtaaagtgtccacattgtagttcttaccgttagtaactctaataatttgtggatgttttaaattaaccttttcagctaatttcctgactgaaagcttatttttatctagtccatctttaattgcattaatgatcttaagtttaggtacagagatagaataatattcttcaggaacttccataatgtcttcaatattcatttcaataatatcgtctttatttgataccataaatccatcaatcctttctagatagaatggtaccatatgagttaccactttgcaatcttttatttcactggaatcatgtagcttacatatacttcaattccatcttcagttctatattttgcaatcttgtctggatcagattcaatcttttcaataagtcgctttgcgcctttatttcccttttcactattggttacagcaatccaagaccaataatattaaaaaatagatgcagctttttagtattaaagcaagttccctgtcttaattttttccattaactatgtcgttgatcaataaactcgcttgcatatcggtatagctctttatattccgtttcatcaactggagactctattaattcaaccccgttctttacggcagtgtaggttcttccatcatggggatacgtttcccagacaactgggattgtaatatttttgaagtttgaaagttttttagattttttaaattcttctctttcagttatcctagaagctgcgatgtctattatctcgccatgctacccacatatgaaattcgaacggaggattccacttgtattgaactggtaatgatggaaatataactgatcctgcttttaattttgcatttttattgtatttctctttcaataaatcttttgttagataagatgtataaacacacgcgtcgcctattcttatcccagatttatcaaaagcaaagaaaatactttccacaatatttttttgaataagctctttattgttcattttgcccctccgtagtcgttaaaagaatgattttattcagtaacaccattttcatattcaaggttgtatgttgatatttcgtgtactcctatatcccctgcaaagtttccatcctcatgttcctgttgtaaataaacctctttatctttttcgaagatttctcttgcttcatctaattcagttacagcttgcgatcccattcgatctgttacagtaaaaactaagcaccgttttaactcggtaccatctttaaggactacgtctgccatgacgtacccatttggctttagttcgccaatttcattacgtcttttatcgattgcctcttgaagaaccacagaaacagtattgttatcagactcacttaaagccatttctaattcttcaatttcctcaagtaacacttgaatttcctctctcattttcatctctccctttgttgttaaatgaatcattatctctatttaagcaccctgagtatagcctgatttgtcaatagttacgagatgttcaatgtcatcatagtgctctgcgttcatgacctcatatatatcaatcccaagattcttttccaaatttcttttggcatgtaaaacaatcatattgtctgctttaatgccattaggcatttgtggtacacccgcatctgttttgatttctacaccatttacattaaaagttacttttactgtattttgcattgcaatctctcctactccctatgaaagtacgattttatttaaacattgcatttaatatattcgtcaaaatccggaaagataagccagtcatttgtcatcagctcatccactttttgcaaaaattcttttgatctgcctttcaatttaaaatcgccgtctcctccataaaattcgctcaagccttcataaccgcctgatttgtagtctgatataaaacatctcccatcaaaattcctattgtttcctgccttttctgaatctataattgcacgagtttcttcctctattgcttcaaaattgtaactctttgcaatccgatttacctctgtcaatctggagatgatttcatctgaccagttacccctcacatctcttagaagtgcttccattaagatgatttcttcttgctttatcatggcctttcctcctctaattaagtttgtattcctactccataaccttcccttcaagtacaacctcacttgcagtccaagtgatctcattaactccattctcatccatcaaggttttcgctttactatccgcgctcacttttaggtcttccaaactttcggctttaattatatcggctaatagcatatagtcctgatcgtaaaattttactgaataatccttcatatattctctctccttttgttgtaatgtgcgctttaacttaaccttgaaaattttcattcccttactttttttgtaactttagtataccatgatcactttaagtgatcaatatctttttaatcttttttgtaaatcaacagctcatgcaactcaatatctaaatatgtacaaactttatcaagcagatcccttggataccgctccatttcgtcatgatacagctttctaactgtgttgaaaccatggtcaatatcattggacagctttcgaatactgatattcctttcgtctaatatcggctttaaatttgatttaatcaattttactacctcacattcattatgtatgatcactttaaattatcaccatatgcataaaaaaggtcaaggatataccttgactatgtattaagcttaccaatcaaatgaatcttcatgttcaaatccataaatacctttaatccacacgtctccgcagcctggattctttgtaatctctaacacatgattacgatttgcatctccctctactcgatctgcagcagtatagtcggcatagttccctacaaactgcttttcactacgtggaaatacccagccagcaagagttatcctactgatttttatatttagagtacacccttctgcattgctaattgtgaatttgtagaagagccaagtgcgatcataattccgatcaaaataatctgccattgaaaaactctctgaatcctcactcatgtgaaaattcacatttttgtagtctaatgtaagcttcgcctcagcacttggtgtgttaaaactcaatataaaaccaatgcaaattacagccaaaaagattaactttttcattccctctcccccttttccaaattatactatatttgaaatgaaggtgaaagaacaggcagaagcttcgtgatttatctgtattcttcatgatatagctagatatacatgcatctatgaatatcttcgtgtatttataagtatctatacctccctatatcacacaaatacaccttattgagaacaaaaatatttattttagttcatttttaagaacaaatcttccatttttatgatataatcatcactgcttataggcagccttactgcttattcgccatatggtataggaaagaggttcttttaatgaacgtaaaacattctaactgtttctttgttatcaggctgtttgccgctctctgtgtgcttattggtcatgctacaagagatctaaacatttctgtctttggttatactccagagagtaaagcaatatttcacaccggcatatcaatcttcttttttctaagtgcattttttcttttcacttcttatgagagatcccagcttaaagggaataatgtaactgatttttattggagccgaattattaggatcgcacccgcaatatacacctatgctattgcctccactgtactgctaattgttctaggagctctttcattgacagtattcactactaaagagtactggacatggcttcttagcaatcttgtgctataccctcaatacttccctgacatattccatcacattggcacaggtcgccttaacgattcactttggacaattcctgttcagattagcttttacctggtgttacccgcaatttattggttttataaacgcttcggattcaaaaaaatgattctttgttcttttgctgtttctgcttttagtgtgctgatttctttcgtggttttgaagttcttgcctggtaatgtgttcggtaacctgtacttacattctttcctgccacagatgttttatttcactttgggcatcttctggacaaaggcatggagtaagtcaccgcagcaccttgttttatttttgtcttcggtaattttatttttacttattaaggcagatcccatgcatcttagttcaataaacagtacactatggaactttttatggtttgtgccgttaagctatgcgatcgtttggttcgggtacaatgggccgaaaatattttggcaactgaaccggttagatgatatcagtatggggattttcatatggcacatggtgattatcaacgtcttcctatacaccggaattaataaaacactgtctgattacccgttgatcatagttctaattgctgtcactgctgcaatcgcatttctttcgtacagaatcgtggaaaaacccgctcttaaattacgtaatatcaagaaaaacaaaccagtcaaaacgaagattgcgagctaatggccaagggctgttcatgtaggcagcccgtgtcccatttagcatgaaatggtgtttttatttagaaattagattattctttttcacaatgcgttccattaaattttgatctcttgtggaagttaacttttctctttttacatctccatctgataagtgcctattggttgttccagcttcttctctatcgatacaatattgaaaaatatcccttgtgtcttcttctaatattgattctaatgttcctgtgctcataacatggtaagaagagtcactaagcactccaccattttcctttattgcttcttcgagtccagtttcatctgcaatattaaattcttcaagtgtaatagcaatatgtgaaattcgcgaaatatttttaggtaacttttcatggtttataaagccgctttttagatgaccttcctttttaaaacactgagcaagtgcagcaccaagtgaagttttaagctcttctttatattttgtataatttgttgttcttaaacttatcatgggtactcttgcttttaattcaataaagataacgtgattatttttaactaacataaaatcaggggatcttaaattgttcttttgaaatctatacacaaactcttttatataaagataattatgaagttttaaaatatgttctatgtaatcttcgtaagggtgttttccaaaagcacttttgaattccaaaccttttgcagtgcaaatttgttgatacatcccctctgtaacagctatgaaaattgaaaaaggcattggaaataaaaggtcagagccatttgaggttacaatcggtttcattagtaatgggttgaaatcatagactttcatttttggatcaattgttgcaaattgttcatacaaaactataaattcttctctattaattaaaaaggtatttattaaagttttcacttttgtttcagaaaatcgggaaatttccccaagtgttctaataaaattatctttatcaatttcccagtatttcgaggaaaaattatataaagcccaagagaataacaaataatcttcatactcataaccaaacaattcaagaaaaatttttttaacattaatttcagggctttcataattaaacagatagtgatacctataaaaacttttaaaaggatgcctctgataaataaattgttgtaaaccgactctcacagaaaattgtgacaataattcctgatcagacaaattcaaatcatctttatgcttaaatggaatattatattctcgatataacttaattactttcactaaatcattataactaatatctggcgtatatccaccccactctttccctattatagaggctaaggagagatatgctagttcatgattatatatgttacctctaatttgttttcttaatatattattaggcaatagactgattaaaaaatcatcattaggattaattacagatgtagcatgatgtaacactcttaataattcaagtttagaattaaaattaaatctccttaatcttttatcaatctcattaagtatatttatgttagactcatagttatccaatctcttcccgccctaaatatttttctcttactaaacactacttctaattaattcaatattatagcatgatactctatctgttaactctctttaaaactgctgttttattggaacctataatacaaatgtttttgactcttcattcgaaattaacaagataaatccctgttcttcatcttcttttttatgggtttcgcagtaatctgaaattccccaaaatctgtttggatatgtagtattttttgaaggtgaataaattttgtatctgttaacttttccgatacattcttttgaactacaagtacaaatcattttaatctccccattcagtttaaaatatgcatttcatttagattgttagcaaacaagctcctgttgcctatactcatcaaaaaacatattacagtgaccaatttgactaagatacaggctctccttaggtcttgttacaccgacataaaataatcttgcttcatctaaaagatcgctttttctatgaggaaacttaccatcttcaaccccaattaagaacacatgtttaaattctagacccttgcttgcgtgaatactcattaatcgcacggcattttcatttttctttttacttggcttgctgccgtatacaaaattaatgaactgctctaagttattattcttaacaaatttcttcatggtattgagagattcttttctgtcagttatctcatcttcatcgaggtatttctcttctatgtaatcattcattctgaaagttttaactacattgtcgatcaattcttccacggcaatccctttaagcacttgcatttggagtttattaatcatactttggaatttcaagacgttatcgttttgagtcggacgatcaaatctcatatttaacatggcctcatataaggacatatttgtttgtccggcaaatgactcaacatcttttaaattcttattgctaaaataacgaaatggatcattccttagtgtgaaaatatctcgaaaggctgcatcatcatgtggatcacgaattaatcttaaataagctacaatcccttttacctcttttctcttgaaaaagctcccattattagtaatatcatattcaatttcacgcctttttaattcattctcaacatagctagaatgagagtttaatctataaaggacacaaatttctgatggtttttcaccggctttaagcaatgtttcaattttatcagctgtattcagaccttctgcttctctgtcctgatacgttagtgtttgaatttcgccattgttatgaatattagggacggagtctgcgtaatgttcatagtcaccatagtattccttgataaagctgtttgcgttatcaactatgtttttatttgatctataatttgtatccaggttaatcacagtggcgttttcccaatccttttcaaactccatacaatactcagtattgccgcctctaaatgtgtaaatagcttgtctataatcgaataagcagaatatgttaccagaggcgcaaagttcttttaaaatgagattttgtactaagttagaatcttgatgctcgtctacaagaataaattcatacgtatacttatgtttattgttttttagcaccttgtaacactccaataaataatcatcataatcgtacagtccgtttttggatttaaaagcctcatactccttatagaagagacgtaattgctcctcggtatatttactctctttaattaaaaactcgtctgtgtagccccttaaaaagttcttttggtagctgatgaaacccgtaatgtctttaatgtcaggtttctcttcaagtgatttaaaacagttttctcgctgccattctttaatcgtatttttctcgttaatttcaattccctctttgagaagaatgttgcggcatactgaatgaaatgtacctacattcacactagttaatttctgcttatgtaatttcttcttaagctcatttgcagtattacgcgtaaaactgatggctaaaatatcctcttgatcttcaccgtaatccctcaccaatgttttaacacggttaaggagaacggtgcttttaccgctccctgcccctgcaatgactgcgcaagctcctttataaaaattaattgcttctaattgttgtttgttaaattttacagtcattctaaataattcccccttttgttccctcttctgttttttctaaatatgtaaataaagcattgactttctcttgttgaagtgaattattttcatgcatagctatgtattcgttaattttcttgtcaatatattttctgctcggtgtccatcttttaacaactttcaaagcagcttcaaagtcattaatgttaatgctcgaagtattaggtacatttagagcttcagatacttttccatagcattgcatcaacaaccctctataaaataaaaggtgttctggactgccaattggttttacataatcaaacactctgcttttagcagcatttttaaactctagaaattttcctgatttatcatgttggaaggtaaagaatgtttcatcatattctttaaattttccttccatctttaaaatttcttctgcattttcactttcttttaaagacaactgctcaacttgcagctccagctctttttgtttatcagccatttttataaaatcttcacttaatctatttacttttaaacttagtaccttgtccatgagcatatcaatttctccgtttgacattttgttcaattccagttcattaatcgccatattaaaccacctcaataatattatttttattcgtaatttttctcatttctttgcaccaggattccacatgcccgattacagaatcaagattgttcattataatttgattgtcactcatattcctaatggcctttgcatactttacaggcgctaaactaccttttagtactttttcaatctcccaaaccatttcagaaagctctgaagtggcctcaacttgtctccctagatcatcctgttctcttgttacggcctttaatttgtttgttagctcctcgtattcttttactttcacatcactcctttcaagttgttgctctaagatcattttttgttttgataagttttcatattttttatttttatactctaattctttttttaatgtgtctatttgtttgtagtcagtgttatcaatgactttttcaacaactgtcttgtttttcttttcttggtttaattcataactaagattcttattatcctcttcagctttcctcagcttagcttcaagctctttgtattcctttaatgtcttaacttctccatttaggactgcttcctttgcttgtttctttgattctgttgattctgatgaaggttttgcaatttcgtaagttaaggatactgggagatcttcaagcaacttttgatcgtaacaatttgttaccaacgaatatctttgaatcaatctgttcgcttgcatcttgtttaaaccaatagattctacccacgcttgaaaataaccgtacccattcttagctaaaacatcttgagcttcctttaattctcttcctagctcggtataagctttacctacaatctcacgcatattaaattctttttgtttaaggaaatcagcagttgattgatcgactaaatcatatttgaactctgttgataattcgtttgtcattgtctttacatcctttctaagttaccgttcctatccatttttaactttatgtttttcaaagggttatcctcttttttcactttttttgatttggaaccctcttcatcaaaatcaatcaactcgcttgcaataagctcttgaagcttgtctattcttttcttctggctttttactttgttactaagtttattgatcttgtcatctttatcagctaatagtttgtttgttccagtcttttcatgtttcaaagacaaaatttcgtttttaagatcaaagatttcttttgttgaggtttctgtcatgttttgcacagattgctgcatattaaaaatcggcgttaacatgttcttcacctcatgtagaatttgtatattgttcgacttcatcatttctttaattacatttgtatctgaagcaggcacaacaacttctttcctttcatgaaaaaccgatggaacaaactcttgttgagtaccgtcctcctcatttgtgagttcttttcttaccttaatggctgtatctgaatttttaaggatcattgccaatcttaaagctactcttttaggaacgatatatagcttaatgaatttcccaggcatattatatttatgcttaaatccttcaagctctaatccttctagtttctttagtccatcttcaaccaaaacctcattatttctgtgaatgtatgtagtcaatgtaggtactttcattccgaaatactctgacaagaattttattgaggtatgttttttgtcacctagcatctttaactttttcactttgtccaagacgtcaattcgatccatgtactgctctctttcactttctttgattaaatatagattggtattcttcatgttatgtattctcctctttaaattttttaagtttaatgcgcccttaaaacattatattttatttttattcttaaagtatattcacttcactgttgctttaacttgattagagtatagcatgagtatttaaaattaacaatagttattttatttttattctaaaaaaagaagaacatattatcgaggttcagcttgctgaaacgagacggccgtaaaggcactttacggacgaatttattatttttttatttaattatttttctggttctccttaagacttaggctctaaaacccttgatatgactggcttattttttaagtttaagaggtttgtcctctttatcaagtatcgagccagtttgtgagcagcttcctcattctcaaagaaggtatgtacaaagttatttcttctccatccctaatagcagacctccatacccattgcactaactcagacaatgcaaatgcgtcctggtctattgtaatactgtacttttctttaaaataattatacagaacagtattcgtatatctgtttattgtatatgctaagtgtttcttatgcttaaactcgtttgtagcacgtgcattacatgagacaaacccctttgtatacccattgccctttattctgttcttatggtctgaataagtcgtccacatagcttcatcacttgacgacttaacaatattattaaagtaattgaatacattgttcttcacctttttgattgtgtaaggtgatttatttttataccaattagaagacagtgaaaactccagttgtcctattgtatttaggttgccttcatatatttttattttatttcttaactcttttttaaagttcctttcaaaatcagtatcatggtcaatgaacctatactgtccatctatgtaagctgaaatatacttctgatactcaatattgttcacatcgtaataatatttttgtatttgagcatcaaacatatatgtaagtatgtaaacctccttgaataactggaatacgtcggcaggaaagttccaaatcaatatattatctttaaaatacattaggttgttatttaacgccatatctcgaatatcatcgtatcgtgtttcataatcttttttctcttcattccatttgacaaaaccgttttcaacataaatcaaattggaatcaaacagtgttgttagatcatgtttctttacctgtaattgttccactacttccatgacttcatctaatattagtgtgtaattgcctgcaagtataagttcctttgtctcgtcgtttgcgtttttaaaaaggttatgagttgccacaatgtttttattctgtgataagagttcgtgaaaggattcaaacttatattgtgttttatcacctttcttctttactttaggttcgaaaaattgtttggactttatgcttttctttatgcgctcaacttcatttaaataaggtgtgatgaatataaaggtttcttctttgccagcagaattcattttgttaatcgctgcagatgttttaccgctccccataaccgaatcgactattttaattttattcataatataaacagacttccccctttaatattaaaaataaaggaacggataaatgttttaccgctccttctcatgtatgaaattcaattgttgattctttcttcaagatcatgaatacgtctttcaagtccagagaatttcttatcattgtatcggtggtcactttcaatattcttgttaataatcttaagcatggatacaacctcttcaggttcattttcttcgattcgtttaaccgtttctttaatatccttaacgtcctgcttaattgtgttaatatccttggaaagttgctgtatcgcttcaaggatctgattttccattccgctcacctctaataagcttagtatagcatgatgtcagttagatttgtttaccttcttttggcgtataacaaagtaagcgatccataacaaaatgataatgatacacgttactatgaagatagccataataagcgactgtattccgctgctgaagtaatctttgatgaagaggaacaataagaataaaacaataaatgttatgttcgtaaaccataatgagaatcgtttcatatttacaatgtgcttgtccatgttataatatgggtagtaactaaaggggaattaatcccctttagcgtgttatctgcgtatacgtttgcgttgtctctctggtcggagacgcttgcgtgtacgctttttctttttgctttccttattcttcatcaggttttgaatcttctcagctatcgttaaacagttgatgattaaaaccgtgataggaataaggaaagcaattgttatacccactttctcaagcactatgtacacctcctttcctataactctattataacacatttttccttcgaagtcattttatttttactcttaaaatggatttttttaaattattttggcactattatttatgggtgtttataagctttatgaggcgtgtatgtggattggatacccaatgtactatgattcatttaaaattgattctaggtgcattagaatgcttctgatgatgtgtggtgaatggaaacggatagagatgattaggtaagattaagggtggatgtaatgaggggatgagaaggaatattattagagtgaatataaaataggtattcggattaagataaaaaattgtatagataacacttcgattcattccctttcgttatacacacgattatttttaatgaatgggtattcacttttatattgaccacttaattattttttcaaaaataaatattgtttttcatttgaaattgtgttagttgtgcaaatttatcagccaaatcataaaaaccctacataacgtatcttatatagggaattcaataccaatatatagggggtatattaacatctaaaggccaaaaaacaggaacaaatgtacccctagcacttccatttccacacccaacttattttttcacattcccatttttcagcctattttcgcatcgtaatcgctatcgtaaaagcctatagtatcaatgtttttccaccccttattctcccctttttcatcagatttttaactcaacgaccacttttcctctctcctgcctacgttttacgatcacaaaacacctattatcccctttgacagctctaaaacattgctatatcaactaaataaccctttccgaccttcatttacgataagcactttttttagctcacgatcacccaggggggtcattaaaaatcaaaataaaaaagccaccttaataggcagcttccctttaaaattaacgttttagtctcttcagtgcctccatatacgaggtctttttcgattccttgttctccagtttttttggtttaaataaatcctctctacggcgattcttcgctttataaacagttgtttctttaacttcagtatttccatcttcaattagatcatctaactgcttcatccgttcattgatccaggttaacccgctaagaatcgttatcgccctattacctttatcataatgccctttaaataaatctaggggcatcttgttttcaaagacattaaacagctcattatacgatatatgctccgttaagaactcatgaacatctaggataactccagctctcatcacattttcaaactcaacaggagtgaaaatcgaattgttccacgacttttgtatatcttcatgcagcttatcaaaatacttaccctcatttgtaaattcattgaggtctgtttgagcaatagtcatgattcctggtgtatcaaaaagctgatttaaatccttcctgtctaatgtactgatctttgatcctctgtccgtgtaattgagtaagatttcaattaaatccaggaacattttgtttgtttccttgtagagtctgctctcagaaagcttcccttcatatttactcaaaaccatttgattatccaaaggtaaaacacatgtctctggcatagataagtcttcaagtagctccagtgtattcatctggttaaccaatacctcattattgtcaggaaggattggtacagcaactattgttttatgtgtaagacattcgtttaacaattctaataatataggggctactcctgaaccggttccaccagctgcagagaaaactacgaaaataacttgtactgaaggcttttccattgtgttctttatgaactcaatagaggactcccagttatttttcatatgtttcgctgctacgcttctgtctttacccactccttctgttccgaccaaatgcagcttatcttgaatattgaccaatgaattaaggtctgaaagtgaataatttattgcgacagaatgaaatcctctcttcattgcttcatctgctatacttccaccggcctgacctactccaataaatccaaacattaaaccctctccccttctaattgatatctcaaagcttcttgaccatattgagtaataaaaattgtatgctctttactgtttttcactatattaataaactgcaaggcctcaagacgatcaatgctctttctaaaggtagcatcagttaactgagtttttgcttgaatggttttcttcctaattgatttaaactttaaatcagccccttcatcactcaataagcctagaatatacagatcatttcgagttaagttgtcaattacagaatcaaaataagtatccatgtaacccctccttaatatctgatgattttgaagtatcttggttgatatacgattattatattgtctatttgtatttaaatgcaaatatttttgtatcttaatgcaaataattacactctgcttgtatgtaaaccagtgattttataaaatttattcaaacagcaaaaggatgatttaaatggaatatagggttaaaagtaagttggattcatttctaagcagcaaaggtatcgaaaaaggctggttagcagagcaaataaaagctgaaagagcaagtatatctagatggtgtaaaaatgacagcgagggatttgcaaccgtcctccctagtacatacaatcttttattaatggcacatattctaaattgtaaagttgacgatctttttgaattaatcgaaattaaatccaattaactttggatttttatgtttacaagagtaaaaataaaatatataataaagacacaaccacgtgaagtggtctttattttaatcattttaagagtaaaaataaaatagtatggaggtgtaagatgaaaaagcagtatttatttagtcatttaatggggtttattgagggaaaagtagtcgatgggacagcaacacccgaagaagaatacctttatcaggattacaaatggtacggaaagattaataagcaaagctttacatatcgaagtttagtaaatcaatatcttaatagcgaatattaagcactttcagagtaaaaataaaataaacggaggggattgattgaaaagaaaaaaagacggattgtctaagcaagttcacatttacagtgtggatacatcagcattttataatgacaaagaaaatttattacataataagattttaaagtcttatagatacagagattatcttaagacattagacaatgtacataataaacataagaaatacatttcacaaagaattacataccttaaagaatgtctctattctgcattcgaagaacataatgacataagaacacttcgaactgacagcttaagggacaataaagtgatttctttatttgattcagtgttgacccgaacattagggattaaagaaaataccctttcagaggaaatcatggttgtccagacttatcattttgaagtattgaaggacattattgatcaaggatttttacataacaatgaaaaatacgtttatttcacaagcagcgccggtcaaattcgtacaaagaagtcatgtttcattaaaaaaagcacctacgataagtatcaggatgctttgacatgcggcttaagtattgaaaagatcaactcccttggtggtagcagcattaacaaatggaatagctacatggccttatctaacagcgccagtagcccttgggagattgatattgataaagctattgtagtcaacgacttagaaaccgatgtgtcgagtctcgttgactacattgatcgagaatacgagatcactcgaaaaacaatgaacattcccattgagcatacagatggctgcggaatgatactccccactctaagtcataaaagcttcatggtaaggctcccgtgggtaaagggtttattagtcccttttgattttcgtaaatttgctgaggaaaacaaagcttttaaagtaactgatatatacggcaaggaatgggacatagtgaaagatgatgttcaaattatcttcactaaaagtcagtttaaaatgtggaagtattattcatcgtgggaagaatatcaattcaattataaaaaatatggatgcttaggggcaaaactcaacgaagaagatccttctgttgaaggcaagctcacttatcaaatgctccagacacttacagatatctctgatgaagaattaattcaaatgagctcaaagactgtaaaagaaataaccacattgggcactgataaagagaccatgttaagagttcttggagctacggagaaaaagaaacatcggacagctcttcaggacgctttacttctatatccagaacttcttaacgatgatcacacgaaagaaattattaaaaataaaaagaaaagcatgatcaaagatgccaaatcaggaaaattgcttgtggatggtgctcgttatacatacttatgccctgatctatatgctttctgcgaaaaattatttctgaacatccagaatccaaaaggactgctttcaggaagtgatgtccattgttctttatatgatgaagggtatattgacatcctccgctcccctcacctattcagagagcatggtgttaggtggaacaaaaaagatgagaaatatgaaaaatggttcattaccccaggtgtttacacaagcatacatgatccgatatctaagttgctgcagtttgacaatgacggggataaggccttaattatttctgatgagttaatcgtcaatattgccaagcgtaatatggaaaacatcgttccgttgtattatgaaatgtctgtagcccagaaacaagagattaatagcaagaacatctatgaagcactaactcttgcttatgggatcaatatcggggagtacagcaacaacatcactaagatatggaacagcgacaacataaacctggacgtgatcaaatggttatgtatggaaaataactttactatcgattttgcaaaaaccttattcatgcccacccgtcctgatcatgttgatgaaaaaattaaagattacataaaaaataaagtgccccacttctttatcaatgcaaaggataaagaagaacatagtgttgagttaattaatgaaagcacagtaaataagttagactccattatcccttctgaccgaattaatttcgcagctgtggcaggaaagttcgattatcgtttccttcttaagaacaaggatattaaattggacgatgcaattattagtgaatacaaacgattagaccagaacaaaaaatggctcatgaatgatgaagacattaagcctggacaaaaactttatgtttataaggttatcaaagacagattgttgaagatacatgaagacgaggaatatgttgctgatgttttagttaagcatttatataaaaagaaaagcaaatttaaatcaacattatgggagtgctttggcgatgtaatattggaaaacatacagaataatctaaaaagatttaaatcttgttatagttgtggaaagatgtttaagtcaatctccaataaatcaaaatattgtagtaaatgtgcattggaaattgaaaaaaagaaccatcgaataaggcaaaaaaaatacagtaagaaaaaaatgacgaaatagaaagtgccttgagccttactcccccaaggggtacagcgattttaccggaaaaagtttaacgaaaaaagcgccttgaatccttgatatgactggtctgaaagccccttttgagataatcgccataagggagaaagaaagctaatttccacatataagggtgagtacgtctcccattttttcaaaagaagcacaaacgataccgtaattatactttaacacaaaaataaacaaaatcactaggaggaattaaaacatgaacaaaacagaatttgttggagaagttgcagagaaattaggagttactaagaaagaagctacgcctaaagtagaagcagtatttaatgtgatcgttgaaacacttacaaaaggtgaatcaatcaagattcctggagttggaacatttgaagttcgtgaacgtgcagctcgtaaagggagaaatattcaaactggtgaggaaatcgaaatccctgcttcaaaagtagtgaaatttaagcctgctaaagcactaaaagacgcagtaaaagcttaataaaattaatgaggacgacaggaaaggcttcctgcacgctttgtcacatagagcttatgctcctaaaagtggcagagttagatgttatggaggaaattgtcgccctcccctctttttacatgtgttcatctccaggttaataaattagagttcttttattggtggcatgggggtgtcgtcaataataagctgattactgatatgtgggatatcagttctccgctaatattcatttgtttgaggacttggaatgtcagggtttcggataagtggatattaacggggtattgcccttgcgtggaagaagctttttctaaacatgtctattctcactttcatacgaacaaagcattaaattcgactttacaactacaactggtcattgtggttggtcggataatggtcatttatgagggttcgaggttaactcggatgtctgtatcttaataagataggtaaatggatattatcgggctaaaaatgtctataggcaacaacttagcctctaaacttttcaggatggagggtcaattttggttgaatttgattatggcgaattaaagaagacaatcttaaaaaactccaaagctaatggaattgaaattaatgatgaacaaattgaattgtttatctcttctgaagaagagtatatgaggagtattggtttgatctctgaataattacaatatcagagtcaagtgttaatgattttaagccacctacggcaatagatggctctttctcagtagacggcaatctactgattctgattcagttcttttttcacttcaataacgattttttgaatgagtttctcaaacgcttttgaagcaaggttgcgtgtcatagtgacaagcataaaaattaattgcggtgtattgcttcggcttgcacttaggtaaggaagatgcgtctcccttccctttaaataatgcccttgtaagctttgttgcttattagaggtaatcaaaatttttccgggttagtgagtcttctatgctcgtaaaataagcggaatggtctttgagcgcctgatcaacgctcccatatccgcgcggaagggttattttcggtcttaccttccgatcccatttgcgcatgtaccaagatgtacaaggcgtttctgaagacgataatttgtcttttgtttcgctcgttaatatacgggcaaatcacgaatgcggtggcggaataggtagacgcagacaagccggagggccgtaaacttatgcgaggtgcaaatcctcgcccgcataataaacgaatagccaaggcggcgtgtcaagttatcgcaacttgcttatcaataatctccttcgggcgtttccccaacgcctatccgacttatcttttcatctcccttatatccccttttcggacgttaccgatgcttcggatcatcgggcttccgaaggagcttattgtatgtaaatagaaaactattggaggaatttaaatggctaagaaagttcatacagtaaatttaaaaggaaactatacttacattgatggaattattgaagaagaaacaaaaacagatatcgagcgttatgatctgaattcaattttaaaatcatttgatggtcggaaagtgaaaatttctattaccgaggaagacgaacttccacaaatcaatgagtaggtggtgactgaatgacagctattatagatactgttttacaacgagaaaaagacgaatcgttcactgattatcatattagacttttcaaaaacaaagacacttatcacattgacacaaaaacaattgctacccttttaaacaaggatcagggaaccaactatgatgaaagcaaatggcgtaaagactttaaacaatttgaacgctggcacgattactttatctcaaagaatatgaacaaagaagttcaacaaaaacatgaagaaattcgcattgaatctgaaaaacaaacaattaaagcacgagatcaaaaaagagaattccggaaattcattgccaatcaagcacggtttgaacaaattaaagatgatgttgttcaagctattgcatctctagagtcaaaaagaccccttcgcttcaccttcccatcacctgctattgctgaaaaacatggactcgctctattcagtgattggcacttcggaatggaaatcgacaaccgcataaataaattcaataaagaaatttttaatgagcgtgtagaacatctcaccaacaaagtaattgagtatggtaagcagaatcatatttccacactacatgtagcaaacctcggtgatttaatcggaggtcttattcatgtgtctacaagagttcaagctaatgaagatgctgtagaacaaattaaatatgtatcagaaacgcttgctgaggttttagcgatgttggcaagtgagtttcaagaggttaagttctacaacgtggcaggaaatcacggtcgtctctccccttctaagaatgatgtggggatcaaagaaaactttgaatacctcattaattggtacctcgaagccagattgaagaacataaagaacatctccattgaacctgagcaagacggattcatccccgctaaaatcaacaatcaggaagtcgtgtttgtacacggacactacgatcgtgttgatcagtgtgtaacacggttgcctcaattacttggctacatcccttcttacatattcggcggtcatattcatcacaattacgaaaaagagtacggtagcacaacagttgtagtaaacggagcgcttgtcggtgcggatgattatgctatgcaaggtcggtttggaacaaaaccttctcaaaaatttatggtttttgatgatacaggtattgaggctacatacataattagatttaagaatgaaatatagggttgcgaccaatcgctttaaggagaacgattatggaaaataaagatttcatcaaagataatatcggttattgtttaagtaagctgtctgaactacgcaaggaaggaaatcatccggcatacaaaactatcgccaaatcgctgtgtgagtacatgaagatgataaatactcaagacatgaatgaaattaaatatttgtcaaatattaataaattaatctcatctgaaatggacaatctcaaaatctttattactacttcatttaataagagggattttaaagcttatcatagtttaagttgtgttttcggtgaattgagtagaaatttaggttctcttagaacttcccttcgattgatacataaagaattatctgaacgtgtactgcattatcaaaaggaggattaaataatgaacgttatttcattcattaatgaactttcaatttattgggatcaattttcggaagaatttaaaacggagctttccttaattgtttccagttaatttccacaacttagcctaatcgaagtattaggacattattttttcaactaagggagccttgatgtaggctcctattaactttgtttattgaggagctaattaacctttggattttcatcccattttaaactcaattctcaaaagttattggaggttaaattatgtggatagatgacggtgtatcagtatggatgtgcgaccgatgtggcatgtcatggtgtgaatgttgtaatgaatgcggaatgccacatagcgactgtgatggctgtgattgccctggttgctatgagtgtaatggtgatttagattaaaactttaattttataaagatgaggatgaggaagattgaaagaagaaactaaaattctttgggaatatgtaaagctactaaaagaaattaatgatagtggttatctatgtaacagggaattaaaagacgccctaacaagtctacataaaagcatgggatttgagaaaaacactaaaagtgaacaattgaaccaagatgtcaaattctctactaaacccttaaacggaaatagctacacattgagctcgggctatagtcctgaaagaattgctgtaattaatcctggaagagaagaaacaacctttttaattattgatttatacaattcccgtattgaggacatttcaaagaaagtggaatatggaacgtttaaacatcaggctagtcaaataaaagccataattatagacaaacgaccgagtaaattaataattgatgcaaacggtattggaaaaggtttgcttgatgctcttgctgataccttaaaaggaaccaaggttgttttgtccgaaaatggtgccttaacttataaataaaatacttttttagaacgtccagtgatgatttgagaaatctcgactccctctctattgctgggcgttttataaaacgtgtttttgaaccaaaattttggaggtgaaccaatgccaagaaaagctaaagaaaaggaaaaattgatctgtgctgcttgtcaaaaagaaaaggacaaagagtcggggttctataattcacgaagtagtctgtatgagaaaacaggaaaagtccctatttgcaagacttgcttgaagaaaaacattgattacagcaatatcgagtcaatatatacagtcttacaacagatcgatgttaaatttgatccgttgtattgggaacaagctgaaaagagaaaaacagatacatttagcgcttatatgacaatggctaattcattgaagcagtttaacggtactggttataaagacagtgtttttgacagacaaccagagaagccacttatagaggaatctacgcctacaaacaattctggtgttagccaatctgaaattccagatgacctgattgataaatggggtattggttacacccccgatgagtaccgtcagtttgaaagaaaatacaataaacttattcgaaattacggagaaaaaaccacacttcatactgaaggcttgctttcatatattcgtttccgtgtaaaagaggaattagcaactgctaaaggtgatgtaaaagaagctaaagaatggggttcattagcttcaaaggcagctacagatgcaaaaattaatgtatctcagttaagtaagagcgatatcagtggtggagtcgatgtactttctcaattatttgaagccgttgaaacagaattgggcattatcccccttctcccccgtttagcagcccaaccatatgatgacgctgatctaatcatttgggcgattataaattattacagaaggctcgaagataaggaaaaagtcgactacaaagacatttaccacttttatgatgaaatgcttgaagaggacttcaaatcaaaaggattgtcgcctgaagaaattgataaactaaagagtgctcgcaacaatgttttcagagacttggagaatgtgtacaaagaacctctttatgacacaggtgatgaagattaatggctagttataaaaacttcacctcgaaaaacaagaagcacacaaaagacagaacagatatttacgacgcagcttttgaaacccctctgaatcccgatgacaattcaaacctcattggcaagaatatctccaagtgggctgagttcacctcatttattcgtttttatccagacattttttacgatatgttgaaacccgaagtcggcggaattgagctggatttatatcaaagagtgatgatgagaaccctcagtcgcttcccacagaactacttctgtattccacgtggcggatcaaaatgtgttgcaggagacacagttttatttactgaaaatggattagtagaaattggcgaactattcaattacgaaaaaaaagagtctgaagttgaaacaatacataaaatctcaatgaaaaacagatatggtctaatggaaacttctatggccggcatatcaagcggattcaagaaaacgaagaaaatcaaaactcaagatggttatgacttggaagcaagtttaaatcacccagtattagtaatgtgtgaagatggaaaactaagatacaaaaattctagtgaaattaaagttggggatttattacctatttcaagaaacaataatgtatttggaagtgaaacaaagctaaatgtaagctttgatgatttcttaaatggatttagcaatcaaggcagatggcaagtagaaagaaacaaattcaatattccagaacacattgatgaacaattagcattaattattggttatcttcttggtgatggttgcttgactagaaacaattcaatactttttacaaatgaagacgaagatatattaaataattatatagattattttaacaacgtattaggtattgcagttaagcaaaaagatagaattaattttatcgtatttggtaagctcattcgagaattcttcagacagttaggactggaagaaaaagatgcttttggtaaggaaatacctaaaattatacttaaagcacctaaaaatattgttgcaaaaacaatacaaggtctatttgataccgatggatgtgtgacaaataaaagcgtacaattttgcactgcatcagaaaaaatgagtaaacaagttcaaatgttacttttaaactttggtattatttctttcagaaaaaaatatctaaataaaaaatttaatacttatcattataagatcaatatttctacaaagaatattgatctttttttacgggaaattggatttagttgttcaagaaagcaagaaaaacttatatcaatatgtaacaaaaatcgcaatccaaataaagatgtcatcccttatcagcaagataacattatagcaatttatcctaaaggtaaaacaagagataaattttatcatgttcttaaaggatctaatgatcttacttacgaaaaattatcactattattaagtgaaaatgagcgttttgataataaagatagcgatgaattcaaccatttagtagagctttatgattctaattactattacactaaagtaattgaaacagaagactctgagaactacgtttatgatctatatatgcctttaaccaactcatttgtaagtaatggattagttagtcataatacattgacccagattatggttgcataccatacagctatatgctttcctaatgtaacgttagccattaccgcttctacaaaggaatcagcggtgaaaatttggaaagaaaagcacgaggaaattttaaggttttacccttccattaaagatgaaatcaagagtgaaaacttttcaaaagacagtggtcgagttgaatttcaaaacggggcgatcatcgataacctggcaaacgcccaatcctctaagggtttacgtagaagacgtggctccttagaagaatcggccttgattgataaagatttatacgatgacgctattgagccgatctttaacatccctcgcacaaccatgactggcgaaattgatcctgctgaattaaatggtcagattaaccgattctctacatcagggtataaaaactcagatgagtacgaaaaaatccttacgatggttaaggaaactggtgatcttaaaggatcctttgtattcggatcagattggcgcattcctattcactttggtcgtcaaaaaatgtctgttattaataaagcacgacaagggaatgtaactcgtttccgtcagaattacctttgtgactggattggcgcaagtgacggcgcattaattaatatcagtaaattaatcaaagcccggactattacccatcccgaactttcttgcccgagagataaaaataagaactttttgctgcacgaatatgtaattggggtagacgtagcccgctctgcggctgaatcaaacaataaaacagcaattgttgttttgaagataatcagaaacagcaacaacctcattaggcaagttcaagtggtcaatattatagagccaccaaacggattgagttttaaagaacaatcaatcatggtaaaaagagttttcaaaaactatggaggaaatcaagatacttccctctcaagagttaaagctgttattgtcgatggaaacggagtcggtggcggtttaatcgaccggttattagaggatgttacggatccggagaccaatgaagaacttgggtgctgggctacaataaacactgatcaaaagccagatgtcccgaattcgccggaaatcgtttataaccttaaatcccaaggtattaaccaagacattattactcaattcctggattatgtagagtccggaaaattgaagttgcttaagtcctatgatgacatcaagaaccaaaaaagcatatctgacgatgtaatgattgaagcagcatgtattcaaactcaattgttcattgacgaagttgcaaacctcagaattaaaaagacacagaattctttcactgttgagcaagttgtaaaaagaattgataaggataggtacagtgcaattgcttatgcactgtattacatagctttatttttagaaaaggaagaatccgatgatgaatattcatttggattcttttttaattagtaattgaggaggtgaataatgactacacctgaaccacagtcatcatatgagtttaatacaaatttagcgccgcttgattcgttgttctttaatgatttatttaacggcatttcttacgacaaagttaaatcatggctgaaagaccacaacgtttacaataaacagattagggatgcctctaaattgctttataacgcaaatggtgtgtatagaaacgttattgactacatggtagccctccctactttagacagagttattttgggatcaagtaaagtagctgatttcaaattgaacaaacaaaagttcaatctggccttaaggaaaatcagcgacaaaagtgttgtcagggatgcattaggaaaactcagcaaatatggcactggtttttattattttgattctgtggtgaatgattccttccccactactctaagtgacaatgagatcggaacaataactgaatcaaatgctattgacgactttaattgttcagtcctcccccttcccctcgattattgcaaaattatcggcaggaaaaattcctcttatcagttagcttttgatgtctcctattttgacaagttcacaagtaacggaagatcactaaagcttagacgatggccagaagaaatcagacaaggctatagagcttataagaaagatcaaaatcgaaaatggctagttcttgataacaataagaccattgctgttaaaggaagtagcgacattgaagatcaatggggacgcccaatcggtttatctgcatttattgatatggtttatgatgaatactttgttgacactaaacggaacattttagatgaacttaacagtactttaatctaccagaccttccctgaaggcgatcaaaaagggaaatcagctttatctcaaaagcaacaggaacagcagcatgagaatataaaaaaagcgttagttgctaaaggaagcgttaaaggtgttaagttcttttctttggcttcgggaacaaaattagacaagttagaaactaatgtggatttcttgaaggtaaaaggtgaagacgagctcattaaacgtatcactacaaatttaggatttgccggttctgctctcaacggacaagatggtaactactcttctcaacaaaccaatatcgagatggtttcttcccaaatattctcctggttagaacaaattcaaagtgaatttaacaaggtgataaacgccaatatcatcaaagatcctcgctcttatattgaggtttactacctccctcttacccacgttaacaggaaagaaaaagtccaaaacatgaaagacctttatacaagtggtcgaggcagccttattgcttggatagccgctactggatggaatcctgatgcttacttatccctaatggaatatgaaaaagacgaaggttttgatgaaaaattccctgttcatgcgacctctttcacaatgagtaagaataacgataagtcagctggcgcgcctgagatcgataatcccaaaaatgaaaacacgattaaatcgaagacaaataacagtaacggaacgccttctggctcttgagaggaggtgattaatatttgaaaagcacgattttagaaattaataatcagaaaaaaaccagtggtcaaacatacatcaagtgggtcgttcttgaaattcatgaaaacaatactcagtttaacaagaacggtattacctggctggagaaatacataaacgctaaccttgaatcaatcaagctaatgccaatttgcgcagagttcttggatgatgaaaacagtgagccattcggacacggtttaacagaagtcaaggacggcacccctctctttgaaaacagcgcagtggttggtactactaccaatgcttacattgacactattgatgttattggtgagccaaaaagagtgttaatagctgaaggcttcctatacaaccagcgctaccctaaatttgttcaatggttaaaatcaaaaatgtttgatggtgatttccctgaaacctcggttgagatagcagctgtggaaggttcagatgcaattgaatatgaaggtggctggaaagaacaaggacgtatacctatgaaatttgactttacaggtgatgcaattttaggtattgaccctgcagatgacgctgccattttacttgaattaaacagtaacaaaaaggaggataatttaatgtcaaaatctcaagaagaagtagtccttgagttaaacaacaaacttgataataagaataaagaaattggagagttaaatcaaaaagttgagaaacttactgaggacttaaagcaaaaaactgaagaactgaatgctgctgttaaagctgcaaaggatgaaaaagctaaggctgaagcaaaagaaaaagaagcgcaaaaagccaaggatgaaaaagccaaggcagatgaagagcttaattccctaaaggaattcaaaaacaaggcggtagccgaaaagatgcaaggagagcttaaccaagctttaaaggaatattctcctgaagaaaaggatgtcgcaaaagagaaaattgaaatgttctctaagtccccttctatcgagcttaaaaacgaaattatttctgaaatcaactcagcaatcgctcgatccttcatcgctgaacgctcaaagaaacaagcctctgagactaatagcaaaaatttcgatatttattcagacgttcgtgattctgggcaacaaggttcagtgacaattgatgatctttattaagataaaataacacttttataaaatttaggaggaatactcaatgttcaaattcggaacaattggtgcttataaacaagtacgaaataatccacgttgcaaggctagtgtcgatttagtccctggtcaagtcgtaatccctaacgattcttctggtaacgcattccctccaggcgcatcttcaactgcaaaaggtgacgtgtatgtggttggaaacattattgataaacctgaaattcgcaataaagaagacttcaaagtcctaaaaggtgaatatgtccttgcatttaatttagcagacttaaaaggactgccaattgaactcagctcagacgtggtagttgattatgatgcgcttgttaaagatgacgtattggttcctgctgcggacaaaacaggtaaatgggttaaagctggcgatgacgttgcggagtttaaagtatctctaaaagtcttagagaaaaatacatttggcggaaaaggtttgtacctaacagtacaggcttaattaatattctggaggtaattattaatgtttacagttgaattaaacaatgttcaaaaagactcaaaccattatgcaaatgctaaattgaatgctaagtcccctattgtagaaatcttttctgcagctgcaacgggtcaagatctttccaaatttggcgcaaaagccgatgcagctatggcccatgtgaaggaactagcttcaaaagctcttatgggcaacccagtagctaaagccgagatcaacacaattgttcgttatgctattgagcccaaacttatttcagcaattaagctatttgattttatgggcacgtttagaaatattggttatgatcagcaaccaatgatgacaacatacgcacatgaatccatccgaagccaattccaagcatcccgtggtgacgtaccattcgctactacaacttggagcgaatacccaattggaacacaaaccatttcttctggttatgctgttaactatcgtgagattcaaagtggaaacctcgataaagtagccgaaggcatggagcaagttcaaacagatatgatgaacaaagcaatgtactatgtagtaaacgaaatgttcaatgcaattaaaaatgcaacaggcgttaaatactttgctgaaaccgaaggcattactaaatcttctgtagacgatataatcacaaagattcgtcgatttggacaaccttctattgttggtgatttctctgttgtttctcagctaaatgactttgcgggattccaggctgtagccggagatgcttcaagcactaaactcccacagtctgttatggatgaaatccgaagaacaggattgcttaacacttataaaggttcttctgttgtagaattacctaatgcttataatcttactgaattaaataaagccggcgacaacttcaaaacatatcttcctgaaggacttctcttcttcattcctcaaggtaaaaagtctcctcttcaagttttccaaaaaggcggactcacatcaatgaatggtaacgacattatcactggaactgagatcactcgttttgatatggaaattggagctggtgtagcaaaaggacaagaacatcaaattggtctcatcagagacacaaaatatgaattaccacaaatttaaacaatttaaaatctaggagggctgtgtccctccttttatttttggagggattacatgtcttttaatttagataaaaagatcacaattaaaaacctatgtccatgggatttatatttccgaaagattgacactcacggagacttcagattaccagccaatgggattagacagattacagctggagaagtgcaatcccaagtctatgacaatacctcgctattcactggaactgacggtcaaggtactcatgccaaaatctatattgatgacaaagaaacccgtgtgcacttaggttttgagaccgaagataaagacgacaagcaagaaattgttactgttgaacgaattaaacaaatcttaggctataaaacacaaaaagcctttgaagaaaatgttcaaaaggaaatcttgcttgagtctgaaaaagctcagctgtttgatgtagctaaaaaagaaaagattaatgattacgctaagattaagttcattgaagaatacactggatttaaatttgatactcaatcataagggggttaaatcttgactccttatgaaaaaataattaacgttttccactcaatgtttcaatcaaatgaaattcttcccgatggccttgagcagcagtttttcattaacgcagttggtgaatacgaaaccgaactgacagaacttggttatgatgaaaagtccaatacatttaaatatccccttacctcatcacaaattcaagttttaggaatgcttatgtacaaaggattctctttcagatatcgagacagagccttaaaattaaacaacgttgtaggaagagatgttcaattgacaggtttatctaatactaaagctcaggttaatagatcctatgaagatcttgtcgatgagattgaaaaaaaaatgagcaaactgaaagtgaataattttgattgaggtgattaggtgtctgtagattggtatctaacctcttcttcaaattatttgagtggctgggaaaacgaagagtttaattcaaacaagtatgaaatcttcaaggaaatcttagcgaattcacctgaaacttacgatattgaattgaatggcaagcctgaacaggtaataattcaaaccactcaggacagtgaaacaaaaaaagtccttacagttttaggcttattaaatcgtggagacctgattttatatgacggtagttattggttagttaattcacgccctaccgataacaaaatgaatgacagtgctactatgcggctttgtaattcatcaattagtctaacctcttctgataaactaattgattctggagagattgatgaagttacaggaagaccaataaagattaaagtccctggtgataaggttgacatcccgtgtgtattagaacgaacaacctcaacaattggatcagaattggctataaacattcctgaggggcaagcacatgtcaccatcccctttttaaaacatgaaaaattaaagaagggtctttttctttctttttatggcgaggaattccgtgttgatgatatagactattccaaggtctatggagacaccggaacaattagacttatagccaaaaagaaagttggaggtgatagcgaatgagtatgatggtcgaacatatgacaactgtattcagaactattatgaatgatgtagaattgaatcgtcttttatattataaagatgaccctctctcctcttctctccctgacgttcagacgttggaaaattattatgatccagttgatgattccccatcaatattaagctcaataattaagcgtgctcccaaaactgatgatttaaccgatcaaccaatatgcagactttgtgtttatcttggcaatggaatccctaaaccctcaatccaaagtgtgatgctgctagatcaagatttgatgattgatgtttatacacacattaacacctatgaagagactgaattcaggaacctgaaaattactgatcgtatttgtgacatgctcttcaatcaaaattttgctggtatcggtaaaaatattaaatacacaagactgctcatatcgaacgcacctgaaggctatttgggatacaaattaatattcactttcggagctatgaaatgattgatatggagtttttcattactggagaacctgtctctacagaacttggtgaatgcagattcattaaagttaaagagtacggtcagttagccaattatctaaggctaatcaaaatgtccaaaaaagagatcatttatgtttataacaaagaagatgttaatcgtttcggggaacttgatgagcttgttgctgaattaaaaaaaatgactctttatgaaatttcgggtacccttcctaattttcaagaagcctatagcacagtgttttctaaaatgttcaatggagaagaaatactggataagcttactccagacaacttcgattccattagagaacttgtattaaaaatgtgttgtttgaaggaagaaaaaataagctccaatcctgaaattcaaaaagctaatgagcgaagcaaaagagtcaagagtcaagatggtgattcagttgatatggcagatatcattagcacagtgtcgacttatacaggctacctttataaagacattaatgacatgaccctgtttcaactttatatgacttataaccggattgctcaattcaagcaatatgacacttccacactctttgctacagtttcaccagaagcaggtaaaaacattgtgaactgggataaacacattgacttatttgaggaagagaaacattacataagccgagataagtttatgaaagagaccaaaggtttttctaagggcagctaaaagctgttcctttttttattttaaggaggaaatctatagatgaaaacagttattcaagatacagctgatgtttatttcagaagaaaatctgatggtcagcttgtattcacagcagaagcacaaacagcttcattctcccaagccatctccgaagaaaaacttcgtggtggtatcggaaataaaccactttatatcttgaagtctgaaaaagaaatcaatcttactgtcaagaatgcatatttcgacttagagtggttagcaatgacacaaggtgaaacaattgaagaagaagcaaaagttcaggttttcgaccgtgaacatggtctaattgttgatgacaaaaatgcggttacacttaaaggtaaaccggtaagtgatgtaaccttcttcaacaaaagaggtgttacgtacaagacacctgtgtcaacagatggatcttatttaattcctactggatttgctggcactaaagagaaattaactgcagtgtaccagattaacaaaatcggtagacgcctccctattaaagcgagcaaattctctgagcgatatgaagttgaataccgtacaattgcctataatcctgacactgaagaggtttacagtgatatctacattcaattccctaacgtatctccttctggcgaatttgaaatgtcgctcgaaaacggtaatgcattagcaccagaaattaaatttgaagcactggcggatactgacactgatgagatggctgttgttattgaagcgagtagagaaattaactttgtcaaagacccagatcctggatctgatacagaaacacaaactaaatccgtagacgttggcaattaattttacaggagtgatttttaatggcagcaaaacttaatgatttcgatggtgtaaaatcttcagctagagatgatggaaacggtggtttagtaactgacattcatctcaaatcacaagaaaagcctctacaagttgacttccctcaagctggtttagatgctatcaaaggcatccaagtacaatccccttccgtgaccttgaatgaaagagatcctggtttctcctcttttaaaacggataaattcactgttacttcaacagctcaaaaagttactgcaggcatcactgacagaacagcacttactatttatcctcctgcagaaggcacgatttacattggaaactctactgtgactgctgatacaggtatcccattgacagctggtgacaaacctttttcagttcctgtcgctgctggtaaaacactttatgtctatgtgattaatgacggtactgacagagatgtaagagtgtttgaagctaaataatttgaggggattcttcccctctcctttttaaataaaagtcagtttttaaacagatttaggaggtggagttgttgacagaaaccgatgcaaatattttaaaaaccattccagataaagcaacctttacattccacgaagcaacaactgccccgtctgaaggtgaagaatttgtagtatcacattatcgggatattactgttaagatctctggttcctcaacttcaagagaaataaaattctttgccgtagatgaaaatggtgaaaagacagaaattgctggaacaaacaaaactgattttcaattaggtacgggcacattgaatacaaatgaaatctgggattttgatattgcagggcttttcaaattcatggttgaggttgtttccgtaaatggagatgtaacgattaaaggaattgcggtgagttaatgagtagtagtaaatttgtaggtcagctcaaacaaaacaatgagcaaattaataatcttaaagatcaatttttcagaactgaatctcacatgtctgatcatgaaaaacgcttgaatgacaaagttgatgagttcatggagaagcagaatttcgatttaaaaatgcacattcaaaacaatgcgaatccacatcaagtcacaaaagaacaagtcggattatcaaatgtaatcaatgaagagcaagccacaaaagtagattttgatagtcatcttgacgataaggaaaatccccattcagttactaaaagccaagttggcttgtctaaggttgataatgtacagcaagcaacgaaggttgattttgacgctcacaatgcagacctcgatcgacatatcacaaaggatgagcgcagttattggaacagctccgatgaaaggacaaagtcttttttagctgaacatactaacgatcaatccaacccacacaaggttactgctgaacaggttgggcttgggaatgtagacaatgtaaaacaagctactaaaagcgactttgataatcatctgaatgacactaatgtccatatcaacaaacctgatcgggataaatggaacgctgctcaacttttcaaactcactgccgatgatggaaaagtaatctacaaagacagttctgaaaaaacggaatacaacgatttgattaccaccgggttctatttaatcgccaaccaggggctacactcccctgctaacttgtccaatgtatatttggttgtcatgaattatggtgatacaatagcccaatttgctttagaagcatattacggaactcatagttatttccgatttagaaagagtgattcaacttggacttcatggcaaacacatgaaacgaccgacggagcacaagcaagagctactgctgcactcaactcagctaaaacctataccgataccaagctttcctctccgacatggtacactcctactttacaaaacggatgggttaattacactgatgctaactctacagatcaaacagtgtttaaaactcgatatacaaaggatgctacagggactgtttttgttgagggcgctatagcaaaaggaacaattggctttggagtggctgcattcactttgcctgaaggatacagacctggaagagcgtttcagtgggttggtgtagcttcccaagcaggaatgtcaggtgtcccgcaaactcacagagcacttattgacactgacggaaaagttattatagaaaatagctcaaacacctccaaacccaatgattacattagcttaggctttagttttaaggccgtgtagggagaatattatgatgcaagtatacaaatatgacgaaaattatatttacgaattccctgttgtacttgaagacgatagtccgcttcctgataattgtactactatagctccatccgatggtctttatattcctaaattcagtcctaaaacgaaaaaatgggttgagtccgcctccaaagaatacattgacagtttaaaaccccttgaccccgaaccatcggaagctgaaaaagttaaaaaacaattaagtgatttaacatatcaactaatgatggatggtgtactttaaatgaattggtatgaacttataaaagattattacaacgatggtaatggtgtctgggatgaataccgagtagcgcaagctgtagtaaaagggaaaattacacctgaacagtacgaagaaattgttggaaagaaatatattgaaccaactacctaattatgataattttaggttatgaaaacaataaattttataacattcatcagtgctttagtcttgcttggaggatgttcatttaacgaagtagaaacatcagctacgggattaggaaaaggaagcagtaaacaatacgagccgttaatgattgcacatcgaggcgcatcagaaattgagccagagcataccttactctcctacgaacgagcaataaaagacaaagcagactacattgaaattgatttaagacaaaccaaagacggtcatctagtcgcaaatcatgataagactgttgatcgaaccacaaacggcaaaggagaagttgaggatcttacattagatcagattaaaaagctacgtactgaaaaagggcaaaagatattaacgattgaagaaatcattaaaaagtttggacaaactacaaactattatatcgagactagaacaaacaacaaaggcaaattagtaatggagaaaaagttaattgacatactctctaaaaataaactaatcgctaataacaaagttgttctagaatcatttagtgacaaaagtctaaagaaattacataagcttaacagccatgtgcctcttgttcaacttttaaaagatgaagacgtaaagaatatgagcaattcaaagctaaaagaaataaaaaaatattctaatgttgttggccctaatgccaaattggttgataaagattttgttgagaaagtccacaataaccatatgaaagtacatgtgttttttgatactgataaagaaagaacattcacttccaaaatgcttaaattgaaagttgatggactatttacaaataacccagcttatacagagaaagttctaaaagaagattataaataaaatacaagttttatttagacacctctcccctattgaggtgtcttttttaatgtgtgcagaggatatataaggaggaaatgagatggcatcgaaaaaattaaatcttgggttaatcgaagaaagtgtaagtaaatatgacaagaaagaacgagtgcaactaactgatgacgttcatgtttttatttacccttacttctcccctacccgcttaaccaaaatgcttactgaattaattactgatccacaaaatgctcaagaaaaaaacattgactttaaaagcataaatcctgttcaatggggattcttttcactaattaaagaatttacagacttgggtattccaagtgatatcaaaaacaaagtaaagtggtttgttaagcttgtggactctgaatttttcccattgattatcagtagtttccctgaagaaagcatgaagaaatttagagaagcaacaaagatgatgcaagaaaatttagacaaactgtcaaacatatctcaagaagaaataaatgatcttatccttaataaggtcgaagagattgaaaatgaacaagaggctgaataatggccaagaatataaaagatatagcagcactaattgaatatgccgcaaagcaagccgttcaaaaacaggcaaacacaaaaaatacgctgattaaaacaggtcaagagcatgtgcaatctgatgtatatgacacatacgatcctcttgtatatgaacgtacttctcttttgaaggactcttttgtcattcaaaacgaatctaacggaatttcattagacaatacccgtgaagacaacggcaaggatgttgctacggttgttgagactggtcaaggatacacatatccagataaatacggttatggttacggaaaacctcgcccatttatgaagaatactgctgactccttaaaagatggacgattagttgctactatgaaaaaagatttaaatgcaagtggtattaaaacagaataacggtggtgtattaatggccagagaaataaaacaaaacatgatgcgctctagagccgaaaagttgcccgaagtcacggatgaaatgtggggtcaggttgatgacgagcatagaagcttaacacaagaatttcttgatgcccactcattccgagataaaaccaggaagcaatacaactcctctcttcgtcagttcttctggtgggtgcataattccttgaatgggaagaagctttacaaaatatccaaaagggatttcatcagatatcaaagcttcctgaaaaatagagggatgtcttcaagtggaatcgctttaaaaaaggctggagtatcttctttaaataactatatcgagaatgttgttgctgaagatgacgataattataagtcattcaggaacttcacaagaggtcttcctgccatccctaaaacaactacgtatgaaaaagtaaaagttacttacgatgaatacagaacaatgatgaaagtgcttgaagaagataagaactatttggggatggcttggttagctactgcttttaatgtaggtgccagaagagctgaaattattcagtttaaaaccgaaatcctgaattatgagatacctgaaggtcaatcttatgtcatggctcacaaagttcttggaaaaggaaaaggcgaagggaaacccctcgactacatgattaacacagaagctctggaatatttgaagctttggcatgaacaacggggatatgaccatgagtatctatttactacacagtacggtggccaaccaagacaaatgtcagagggttgggctgactatttttgttctgatgttctttctgatatcctcggccgccgcattaaccctcacctctttaaagcctcctgtattacttaccttcttgaagtcaagaaaattaagattgagctcgtgagtaaatatgttgcacagcataatgatgtgtctacaacaattaagcattacgaccttcgtgattttaaagaagaaaagaatcaaatcttctcgtaaacattatgagcctcttcaatcctcaccaaagttcaattgagaatatgcaacagcaaattaataaattgaacgaagctgttgctgaattaactaggcagcttgatgctaaagctgataagaaccaattcggatctaaacagattgatgaatccaagatcagtgatggtaaagttcttgtttacaacgcaagcaccggtaaacttgaatacgggaagattaagaaaagcttgttgggtgacatatcaattgatttgctttaggcagcactctttatgaaatccctcttttatgcagaatcaagatccttctaccgaagggttttgcttatggataaaaccttaaacttatttccatatttgacgataatatggagaggtgaaaaatatgaataagacaatacttaaacacaatttagtacagatgaatagtcgcgacctgatcaaatacatacaaaaagaattcccgcactctggtgagccctacacagaacaaaagcgcaaatttcaaatcctaaaatcgcttaattcatcagatttaatcttagctatttcccgtatgagtcgaattgaagcgtccttcgatcatacgaaaatgtggacagttggaagtgtgctcataggaacatgtttactatctctcagaattatgtttagttttaatttgctttggtatattctaatcgcaacatcgatttgccttctcctactttttgttgtacgaaaggatagggacattgttattactgctacatattttaaagaattacttgagcagattaagtccgaaaaaggaaagtgaccctcccctttgctagttctacacttttggaaatcatgatataatgtaggaaaataatactggtggtggttggatgggttataagattatggcttatggtggctattttttattcagccttttcttctgtttaatggatggttggaaacctctgggagtttgcttgacaatcctaggcttacttatattagctactgaaccgtacaggataaaatccgcagcgcttgcagataagattaaaaaaaatgctgatatgctaaaggtctacgatagcgaatttaatcctgataatttctttaccacttataaaaccaaaattgcttacaatgaagataaagctatccttaaggtatatcagcttaatggcgaagaaataaacgagtatgttatcccttttgaccaaattattcaatctgaaatctcactggatgatcaggtgatttcgaaggttgccaaatcagggattattgctggaggattattaggtggtggaatcggtgcagcaattggcggtttgtcagcctcctctactcaaacagaaatggtgaagtcaattacgcttaaaattacagtcgaaaaccttaaaaatcctatgcactatatccacttccttccttctcgtgaggatgatggatatgaacctcaaggttataaaaaagacggaaatataattcaacaggctttgaaaaacgccgaatattggcaaagtgttatggatgtaattattaagaaaacaagtacagtcgctcaataatttgagtggctttttttatttgctctgattagccccacttgaaaggatgtgacttatttttgagtcaagatttaaaaataatactgaccccaaaagctgatacctcctcaaagactgtcgaacagttaaatcagcaaattaaatctttagagaaaaagcttaattcccttaatttaaagaccaatattgatgcctctgctttaaagactcttaacgaattctcctctgcagttgacacttaccaaaaacatctcaaatccttcaatcaaacagttaaagaaactacaacgattaccagaaatgctgatggcactgttgaaaaactaacgcagcagtataagaaaaatggcgaaatcattcagcgtgaaacaaagaccatagacaatcgcaatcaatcattacgtgaacaaacgcaagaagttaacaggcttgctcaagcgactgaaaaactaggtcaggtacagaaaagaacagaacagaagaattctcaaggacaaacaacgagggttactcaaaagaaccgtaatggctttgacgatattacctatacgactgatccaaagacaaatgctacgtcgtcaaaagttataacaaattacgatcagcaacgaaaagcaattgaacaactaaagatagatttagaaaaacttagacagcaaggaattgtaactgacaccaccctctcttcccttgggcggaaattaaacactgctcaaacagctcaacaaattgaagcattacaaaacagaattaaaatgctcgatgataagtctgctgctgtggctaaaaataatgaactccgaaaaactattgagctttatcaacgccaagcacaggtaaacgtacaaaaccttaatacgcgttatggcgatacgatgggcgctggaaatagacaagctatccaagaatatctgaatgcagttaatagtcttaacgtaagtgccggcggcagtaatatcagatctcaaatgcaaagtttgaacatgcaattcagggaattagcttcaaatgcgcaatcagcagctagtcaagcctcttctttcggcgcggagctaacacaagctttcaaaagcatgtctacatatttaatctccggttctttgttctacggtgctatatctggactcaaggaaatggtatctcaggcggttgaaattgatactctaatgacaaacatcagacgtgtaatgaatgagcctgattacaagtacaatgagcttcttcaagagtcaatcgatttaggtgacacactttcaaacaaaatcactgacattctccaaatgaccggtgatttcgggcgtatgggcttcgatgaaagtgaattgtccactctaacaaaaaccgcgcaggttctacaaaacgtctctgacttaactcctgatgacacagttaacactttaactgccgcaatgttaaacttcaatattgcagccaatgattctatttcaattgcagacaagctaaatgaagtggataacaactacgctgtaactactcttgatctggccaactctattcgaaaagcaggaagcaccgcttcgactttcggtgttgaattaaacgatctgattggttatactacagcaatcgcaagtaccactcgtgaatcaggaaacgttgttggtaactcacttaaaactatttttgcccggataggcaacaaccgaagcgcaatcaaagcgttggatgaaatcggaatttctgtaaagactgcaggcggagaagcaaaatctgcgagtgagttgattaatgaggtagcagccaaatggaacacattaactgatgctcaaagacaaaacacctctattggcgttgcaaatatccatcaattgtctcgatttaatgccttaatgaacaacttctctatcgcccaaaatgccgccgcaacagcttctaattctgcaggtagcgcttggagcgaacagcagaaatacgcagatagcttacaagcaagattaaataaacttcaaaacaatttcactgaattggctatagcttcatcggatgcctttattagtgacggattgattgagttcactcaagctctgggttctttgttaaaagcatctactggaataattaacactgttggtttcctcccccctctttttgtaacgattagcaccgctacattgttactcagtaaaaacactcgaactttagctactactcttatatttggctcaaaagcaatgagacaagaagcattagctagcatcggattagaagcaggtatgacccgcgctgctgttgcatcaagggttttgaaaactgctcttagagggcttctggtttcctcagtggttggtgttgcatttgttgcactgggctttgctttagaaagcatagtttcatcttttgcagatgcaaaaaaagctaaagatgattttgaacagagtcaacagaccaatgttgaagcaattacaaccaacaaagactccacagacaaactaataaaacagtataaagagcttcaaaaagccaaagattcaagaaccctttcatcagatgaagagcaagaatatcttcaagttactcagcaattggctcagacattccccgctttaattcaaggttatgactctcaaggaaatgcaattttaaaaagtaataaagctttagaagaagctattgagaacactaaagaataccttgaacttaaaaagacggaaactaaagacagcgccaagaaaactttcgaggacgcttctaaagaaattaaaaagtctaaagatgagttgaagcaatacaaacaaattgctgattataatgataaaggcagaccaaaatgggacttccttgctgatgatgaagattataaaatcgccgcagataaagcgaagcaaggtatgcttaaagcacaatctgacatagcaagtggaaatgcaaaggttagagacagtgttctctcaatcgcccaagcatacagttctatagatatcagcaatactttaaaaacgagtatcaatgacattgtaggtaaactcactttaaaagatgatttgaatcctgatgatctcgataaattctcttctgcattgggtaaactccaagagaaaatgcaatcggcattgaattcaaacgatgaaaaagcatttgatagcgcgaaaaaggatctgcaaacccttttggagacctattcaaaatccggttcttctattgatgtctttaagttgagttttgataaggcacaaaagaacattaaagatggagataaggccatttcttctgttaaatcggaagttggtgatttaggggaaactcttgctgaagcaggtaatgaagctgaagattttggtcaaaagctcaaagaagcacttgacgcaaatgatatcagtcagattaaagatgtaatcaaaggcatgtcagattcaatgcagtttgactctgttcaaggcattcttaacggggatatttttaataacaccaaagaacaagttgctcctttaaacgaacttttagaaaagatggctgaaggaaagagcatttctgccaatgaagctaatgctctaatccaaaaagataaagaattagccaaagcaataagttatgaaaatggtgttataaaggttaaccgagatgaagtaattcgtcagcgaaaagttaagctcgatgcatataatgacatggttcaatatagcaataagctaatgaaaactgaagtcaataatgccattaaaactttaaacgctgattctttacgaattgacagccttagaaagcttcggagagaacgtaagctcgatatatccgaggcagaattgtctcagcttgaagttaaatcaattaataatgtagctgatgcgaagaaagaattacataagcttgaagaaaaaatgttgcaacctggtggattttctaacaaccaaatctctgcaatggataacgttagagctgctcttaaatcgtatatctcagcatcagaagaagctacatctactcaggaaacaaacaaacaagcgttaatcgaatctggaacttcccttgagaaatggacagacgagcaagagaaagctaatgaagaaactaaaacatctatgtacgtggctgataaatacaaggaagctctggagaaagtcaatgctgaagttgaaaagtacaataagcaggtaaacgactatccaaagtattcccaaagttatcgaaatgccctgcagaaagaaattaaagctcttcaacaaaagaaaaagcttatgcaggagcaagccaaactcctcaaggatcaaattaagtcagggaacattacacaatacggtatagttacctcttccctttcctctggttcatcttctggtggttcttattcttccggtggcgggtcttactccggtaaatactccagttacattaattctgccgcaagcaaatacggtgttgatccagctctaattgcagctgtaatccaacaagaatcaggattcaatgcaagagctcgttctggagccggagctgctggtttgatgcagttgatgccatccacagctaagagtttgggtgtaagcaatgtttatgatccttatcagagcattatgggtggcacgaaatatttagcccaacaactaagcaaatttggtggcaatgttgagaaagcacttgctgcttataatgcggggcctggcaacgtaattaaatatggtggagtccctcctttcaaggaaacacagaattatgttcagaagatcatgtcaaactacaccaagtcaatgacttctgctaattcctccattgcaagctactacacgaagaacagtgcgtttagaataagttctaagtatggtgcacaagacggtgcgtaccgatcaactccacataaaggtatcgacttcgcagcaaaagctggaaccgcaattaaatcggttcagagtggaaaagttcaaattgctggttatagtaaaactgccggtaactgggttgtcattcagcaggatgatggaaaagttgctaagtatatgcatatgcttgataccccttctgttaaagccggtcaaactgttaaagctggccagaccatcggtaaagttggtagtacgggtaattcaactggaaatcaccttcatcttcaaattgaggaaaacggaaagacaattgaccctgagaagtatttaaaaggtgtcggtacatctatttcagatgcatctcaagctgaagcagaacgacagcaagcaatagcacaagccaaatctgacctcctctctctccagggtgacattaattcagtaaacgatcagatacaagagcttcaatatgagatcgttaagtcgcatcttgatgaatatgacaagcgcattggtgattttgatgtaagaatcgctaaagacaaagccctcgctagtcattatctgagcgatagtaaagagttccgtaagtatacaaacgatcagaaaaaagctttaactgaacagcaaaagattcagagtcagaaggtttcttttattgaaaaagaaatcaaaacaaacaaaactctgaatgccgctcaaagagcacagcttgctgaggaattaaaacaagctaagattgatctcatcaatttccaagaagaagtaagagaacttcagggacagctcatccaatccaaagttgatgaaacgcttaacggtatagagaaatcaaccaagaaaactgaatccaagcttaaagatgttagcaacaaaatatccatgaccgaggaagataaagacaaggttaaatattatagccaacagattaagcttattcagcagcaacagaatgaagcgaagaagtatatcaaacagttggaagcacaaaagaaagctgctaaagggttcccggatattcagaaacaaattactgaagagatcgagaactggaaagataagcagaaggattacaatctggagctttacaacacaaagaaatcaatcaaagatgtgtacaaatctcttgctgatgaagttgtctccatctataaagagatgtacgaaaagatgcgtgatattgaattaaaagcgcaccaaaaagcaacacaagacttgattgatgagatcgataaaactgacgatgaagctaaatttcaaagacagttaaaagagaagcaagagagtatccaaaaactcactgaccaaattaatcagtattctcttgatgactcagaatttggtaagtcaaaggttaaggaattaactgagcagttacaaaaggaacagttagatttagatgagtttcttaaagatcgtgaaagtagcaaacgtaaagaagcgttgcaagatcagcttcaaaaagacgaagattcaattaacaagaaatatgatgatctcgtcaatgatgagcgtggatttaaggaacttgagaaaaagctaatggatgggaagattactgatattgctaagcaactgaatgaattctctaaattcattaacagcaatatggagtccattggtaaaagtatctctaataaccttatcgataagcttaaagaagcttctaatgcccttaatactgtgaccaaaggcaatacaacaggcaaaaaaatatcttcatttgaaacaggaggatacacaggaacaggtttaggtgctggcaagcttgctattcttcatgataaagagcttattctgaataagactgacaccaagaacatgcttgaaactgtaaagtatgttcgcaatctgtctgataacgatctgaataatgaaacacctaaatgggggcaaggtggaaaattagcagctttgattaacaaagggattacttctattccatcaataattcctaatattaaccaagcgagcctatctaatagtttgataccaaatgttaagactgctagcctgccccctaccacaaccgttaattctaatggtgataaaacaattaacacaccaataattttcaatgttgataaacttactggtggggaaactggagccagaacaatgctcgaaaccatcaagaaagaagttataaaattaaatggaagcatgtaagggtctgtataatgcaggctcttcagcttgctttttgattggtaagggtggaattttatgattagagaaagtcaatatttcatgttcgatgatatcccctcttatgaaattggggcagtgaatgtaaacacagagggcggactattggaagagaccttcgtagcgaatagaacagtaaatgaaacatatacacgatcagcttctgaaccgtatgtggacagtgttaaacgtgaaccatatgaaatccctttaaacttttacatagaagatcatttagatgaagaaaatattcgaagagttgcacgttggctaaatgtagatgattataagcctctttcattcagtagtaatttagatatcatttattttgctttgccagtgaatgcaacagatttggtacacaactgctctaatgacggatatgtgaagctgacaatgaaagtatttccttataggtatggacgagaaacaactacccattggtatgacatatcatcaggttctaataatatagaaattaaaaatataggggatttagatatcccactctctcttgaattcaaaaaaatcggtgatggagacatcacagtcgaaaacttgacagcttataaagaacctctaaaattcacatcaattaaacatcaagaagttattaatgtagatgccaataaagagctgatcacctccagtgttactgggtatgagtgttatgatcaagtcaatgaacagtatgtttttttaacaagggggataaacagagttaaaataacgggcgaatgttgtatccggtttatatacagatataagtatttgtaaggggatgttttattgatttacgattttaaaccaggccatctcaagctttctttagcaaaaccaaataaaaagaaaatcgctaatatagtagatttctctaacgcctctctaaatttgaattttgatgaactccacgatctaacttttaatatcccacttaaagcaagatataatttcaagatgaagccaaaccatgtggcagaactcataaaaggctggtatctcattaaggcagagttcttaaacagagttgaatggtttgtaattaccgggttgacaaagtcagaaaatgaggaacaaacaatacaagttagagctcaaggacttccctacattcttcataaaagcaaaatcaaatcatatgaaggcatctctaaaaatctgttggaagttgccacagattgtcttaaaggaacttgctttactgtagactttattgacccctcttttaatgaaaaacgccgctcatttgatgttacctctacccgatatgagtttttaaagaacattggagaaacttttgaggctgtgcctatatttgatactgttaacaacacagtatcattttataaaaaagaaactgtgtccaagtataaaggtgtccaattctctcctaaaaggttcatgattgatatggaagataccattgatattgatgaagttgtaacacgattagacattaccggtaaagatggaattgttattaattcagtcaatcctactgggcagagttacttggatgatttctcttatttcctctacccttttgaacgtgatgaaaagagaaatgtaattaagcatagtgattacatggatgatgatttgtgccatgcaattttagattacaatgaacttgtaaataaagaaggctcttctttttacctccttttaaatcagaaaaaagatctggaagcaataaaaacaacacaggagaataccctcttcaccctagaaaaaattgaattacaacaaatcttagataagatcacagtagcaaaaaaagctggagatgacacgaaagaccttatcaagcaaagagatgtcaaacaacttgaagttacatcaaagaaagctgaaatatccaccactgccaatcagatttccaagataactgaagaaataacagtgttaaaagatcggttatctatggataagtttctcggtgaaaagctaatgaaaaagttgtcttattttatccgtcaagatgattggtctaatgacaacatttttgatgaaacagagctgtatgaaaaaggccttgaggaacttggggagaaaaatacacctccggtagacatcagaacaaacattgtcaacttatttactgtcaacaaagaaaaggatttttgggatagaatttacctgggagatataatcagattagttaatgacgattttagaactgatgtcaaagcaacacttacaggaatgaattttgattttgagcagcaaagtatacaagtaacactctcgaatggaaaaagagctactacgatagaacaagactttgcacgctcattgtatactgctaagaaagcatcaactgaattcaataagaaaaagattgattatgataccctactgaccaattacaatgcacgaaatgatcgtatatctgcacccgtagcaaacccaactatccgaaatgacgggactgctataactcatgttgtaaatgataatggatctgtagatgtatcaattgaatgggattttccagactccgatgaggataaatacaatatcgatggtttccttatccattgctactctgacacatcagatgatacctatctttttggttcaaagatgtcagctgaacaatatttatcagttagttatgataaacgaattgcaacattaaccggtcaagtttcaaataaacactatacatttggagtacaagcctatcgcacagtagagacatccattgatagcagtggtcgaatactatctgatattgtacagcctaaatccccttcagaaaacccctacctcccttctaattctgttgaagtgaaaggaagtctaagcggaaaagttaacgggctttatacaatatccaccgaaacaaagcctatttcgccagatgcaggaacgatttggattgattcaaagactaataaacaagagctttttaatggtgaagagtggattgtgtcttctgcgggctcggctgattcattaaatggttacacgacttcaacgctatccacgcctaattcaatacctgtacgtaatgaccggggaatcattacaggttccatagatggaaacgctgagtttcttggcggtaaactacactcagaatatgcgctatcctctgatgttcctcagatagctaaaggaacgtatgtgggcgatggaacaattagcaaacaaatattgctgcctttcactccaacacatgtgaaagtgtggccagtgtctcctaatgattctatgctattaattgatgagacagggggttatacgtatcagataaatgaaataggaatatccctggttgggggaaactctacatacggaagtataaacgagcttggatttataacaggctcagacagcaatcaaagagggaataaattaagtacaaagtacatctgggaagcatataggaatgtaaactaaacaggcatatccttattggatgcgtctttttttatttcaactttctttctataaataaaattctactttatgcaaagacttgaccgttttcatacgataataccccttcttcacttaaaaataccttgtaaattataaaccattttaccacttgatcccatagcagaaattgtgtcatgatggattttggtatataaagtgtttaacagaaagagtgaggggatcagcaatgagtgacaaaaaatatgaatctatacactggtttgcgtcagtgctagcgtttttattaataattttgaatagtttttttataaaaattgagggtgtaactgttggtattgcgattgtatatatagtgatcatgggaattgttaggagtacatggaaaaaggcttaaagagaaaagactgcagagtttagaagagagagtcgcgcacttggaagaattgctccatcaattacacaataagaaaggacggtgaatttagtttggattttcctcagctctataacgaccctaccctttctcaaaaaaggaagggttcaatcgatgacccttatttaagttatagtgaaactttaactgtttacaatggtcgggccttacttactgaaatccctaatcgtgagtacagagttgtggttgaaggtgacggtaaagaatggcgagaaattgaagatggtgaattagcagacaactactttaaggttgattaccttatgggcgttgtcttttttaatggttcaaacgaaggtaaatcacttacttttacatatcaaggagaaggatgcaccttctcccctgcctcaaggatttggattaaacggcaaggaaatatggtcattgaaacacttcaaggcttaatagatgatgctgaagatgccattattcgtatcaacgaacgaattgctgaatgtgaacgtgtcactaaacgatgtattgaaataacaaattggtgcagacaagcaacatcagattatgagtatgtagttgagaacactagaaagatttacttgccgtttgtgtacacctatcaggatttattgaacacttatccttcccctcaaattggttggactgtcactgtaaaagaaacaggtattgaatatcgatgggatggtttcgactggataaatattagcgtctcagataagtatgacggtttcaacattgtttctagctatgtagagccttacaacatcagatctgtatggttgagaacgaacaatgctcccaaaaagatgagaataaaaccttctgtagaaccacctgacggaagtatggtttggattagaaaaggataaggaggagtatatattgaacgacaatttaattcccataaacacaatgggttataaggacgaagaaacagagcaatggatacccattgatgccatagggttaaaatcaaataatattagatatactgcagacgatatccaagaggcttttgataaagcttctaaggatattaaaaacgtaataagtacagtcgattctggcttaacagatatcacaaacactattggagacatttcaaaaatccctgcatccggtgcaacaattgttgataaagtcctaaatgaatttatcagacgaagtgtcaatgttcaggattttggagctaagggtgatggtgttactgatgacactgaagctttcaaagctgcctttgcaagtgggaaacgagaggtttttgtacctgcaggtatttatatggttcaaggattacatatcccttcttatgtcagactttacggtgttggatctgggtctattatcaagcttcacccaactgccgccggaacatcttgtgtgttaaccaatagcgactacacaaacggaaacgaatatatcttaattgaagacttagacctcgattggaatttagacaaaaaggacaacaccattacaaatggaacaaatgcaaactgtgtgggtattgttaactctaaatttgttcgagttagaaacgtcaatgctcgaaatccaggtgtgcacggttttgatgtaagctcccctgtttggaactcttcctctgatggagcagatcattatcagccaaatggtagcaaatatgtgtggattgaaaattgtactgcaactaattatggtgatgatggcttcacaactcactattctgattacatcttcttcactaactgttatgcttatgacgctaatgggtctgcccacgataaaggctcttcaaattcaaatggttttgaaattgatgatggctctaaaaacgtatggctggtgaactgttacagccgaaaaaactgtagaggatttgaagttaaagcgcacagcagagccccagcagcaagaaacgtaaatttaataaactgctactctgaaaacgatattcgctcatttgacttcagacacgttggcttccatcttgccaccgaaaagatctccacaagtgcattcgatattaatgttgttaactgtactgccaagtaccctatttataatgacctttatacagggttaaatccccgtgctcttgttatttccgcatatagaaatgtcaacgtatcaaacttcaatgcaattggcgacccagcctatgattacaagaacactcctattatcactactcaatataagagtagaaacatcaacctaaataacatttcagtttcgggatttacaacagcgagtaacgatatttatgttatcggcggagctcaaaagtctgacaatgtaaacatttcaaatgtcaccattcatcaatctgcattagtggggattgcggttgggagcagagtagactcagttaatatcaataacgtgaacctaaccggaacaaacaaagcaggttcgataggtgtttattgcactaactcacaagccaatattagcgctgcgatgtgcgaacaatacgctactcccagtaaaattgccggaaaaacctacacttttatcccgaataatttcaaaggcggtttacgcggggctacgacttctggctatgctaaaacaaatactagtgcagtattagcttcatcgggtgaacctcaagcacttggagatgctactttagttggagccactactggaggatgcgttgcaaaaggaacaagaaccaacgttttcggatcatcagggggaagctctgtagatggatctcgtagcggtgtttacaactccaatgattctcatatcgaggggcaaaatgtatcacgtgaaatccacgcttctggcggggtaaaacttggtgaaaatgatcgctatatggtggttggcggatttggcgctactccatccagagcgaatattaaatggatgctaaactccataaatggggatataacatctgcaggaaagatgaatggcggagccacctttagtgattacgctgagtattttgaaagccttgacggaaaagcgattccgacagggacaattgtcactcttgaaggagctaaaattcgcccggcgagaaaaggtgaagatgtacacggagtaatctccgaaactgcaggaactattttaggcggagctgatattcactggcaaggtagatatttaaagaatgagttcggtggatacatatatgaagatgtggtcaacccagaaaccggtgatgttaagaaactgcctaaagtaaaccctgagtggattgaaaaaatagattacgtccctcgtgaagaacgccctgaatggaatatagttggattgcttggacaggtttatgtgaaagtggacaacaccgtttctgttggagatcggattgaaggtaattatggcatcggcacaaaaacagaagacaggttttactcttggaaggctatggagattgtaaccccatattcagacaagcttggctatggcattgccatctgcttaattaagtaatccctcaaaattaaaggaggtggttatgttctagttaaaatataaattttattcaatttacagcattcaaaaacagagataacaagagcatacgtgagataaagagagattgggattcccccttctctcattttgtgttcttaaaactaagattattggaggaataatttttatgaatatcactcagaaccttttgactccgaatagttattcaagacctcgcactggtttgaataaagttaaagctgttgtaattcactgggttgcaaatcctggttctagcgctgaaggaaaccgaaatttctttgaaagccgaaaaagtggaacgaacggatacggatcagcacactacattgtaaaagagaacacagttattcaatgtattccaaacaatgaaatggcttatcatgtaggctcaaatgtgtatactcaaagtgcactgcgaaatcttagctcgtatccaaataactgcactatcgggattgaaatgtgccataacgatatgacaggtaagcctacagacgcaacttataaaacaacattagagctagcttgctccctattgaaaaaatatgatctgactcacgaaaatctttggactcaccatcaggttgttgggtggaaagattgtcatagatattacactaacaatccatcagaatgggttcgatttgtgcaagacgcttctaaaattctaactggtaaatctgtcacaattcctacccctactcctgctaacaataaagaccttgaagctcctgatgttaaaacgagagagtcatatattaagaacacagttatcgcagacagtcttaatgtgagaacacaacgcaattcaaactcctctatagtacttacccttcctaaaggctctactgttcaataccaaaaaggatcaactcaaaatggttggggttatatcaaatatacaaactccaaaggtgctacatatagtgggtacgtcaatgtaagttatattaagagtgatgctgagcttgggaaaggtggctcaaaacccaagacaactccatctaaatcacccggagtgacaaagaaacaggtagttcttcccgcttcagcttcttcttggagaatctatcctcttggcaaagccccagttaaagcaaacgctctttctactcaattgaatccaaaaaaatttggtggattaacctacgacattttagataaccctcaagcagacgtttacacaattaagactgatcagtttggtaaagtgaatatttatgccgctgcttcaacaggagctaagattgtgggtacgtcttccccaaagtctaaatccactcctaagcctaatagtagtggggtcaaatctgcaggcaaaattaaaattgtcggtgtaaaaagcgctgcaatcgttatggacagacccgataaaaacaaagcaaagaatctcggcactgtggagctaggtgataccgtcagcatttctggctcagtgaaagggttaaacaatgctaagggttactgggaagttatctacaaaggtaaacgcggctacatctcaggacaatttgggtcaaaaatctaaatatatttaaatatctttgaggatgattgttgatgaggtatatcaatgattatcctcttattataggaggtgatgtaatgtcacctttctattttatcaaaggttggtgacaaatggataactttgagcaaagcaccatttcaagattaagtgcacttgaagaaaaagctaagcacactgataacaaaatcgactctcttgaagaaagaacaaatgttattggtcgtattgctacgcttgttgagcagcaagtcgaaattaataaggattctcaagcacaatcgagagaacagttcagcactctgaacgaaatgagcaacagtttaaaaaatctaagtaaatcatatgaaaaactggacaatcgagttgaaatattggaacgctctgattctactcgcaaaattgatccttctcagtttactaaagaccttgtgtttaaggtgctaccaagtgtaattgcgtctattatcgcggcttggttactcatacattttggacttaaataaaaagaacaggagacgatttaatgactaaaattaactggaaagtaagacttaaaaagaaaacattccttgttgcaatcttttctgcaactcttttgtttgcacaatccattgcatctgcaattggttacgacatttctgtatttagtgatgatctcactgagaaatttaatgctttgcttacatttttaactgcaatgggggttgtagtggatccaaccactacaggtatctcagacagcgatcaagcaatggaatacacagaaccaaaataacttggggagtttgtctcccctttttttcattttcaagaagaaaggaatgatttttgatcatgcaaataggatctggatatatcggaagtccaatgcttgagaagtcagaatctaaccatgaagtaatcccctccccacctgcaacctggacgattaaatattctttctataagttcagcttttcgaatgatcaggaatgccacgtatcaatcaatggtggagatcctatctatttaagggctggacaaggctttcaaatggacgctcacgattcacctatcacaagcttcaaaatttctgagtcaggaattacatataactttttgggggcgcataaatgagttttttcaatccaatggttaatgtctcaattgtcactgggaagtctgcttatgaaatcgcagtggacaatggtttttcaggaactgtagaggaatggttagcttcactaaaaggtgaaaaaggcaacactggagctactggcgctaagggagacaaaggtgatactggtgcaaccggtgctaaaggagctactggtgctgccggtaaagatggaaaatcagcatatgaattagccgttcaacaaggcttcactggaacattagatgagtggcttgcttctctaaaagcaacagcaaactgatcatatacccttctctaacgaggagggtatttttttcgtttcgttcataatcgaattattgatttgtttttaattttcactcaaattccctttacatttctttcctccaatgcaactatataataaaatggatttgaaaggggtttaggacttggagaacgaaaaggtcattccttatgatttagtagcaacaaagatgaatcattggtatgtggctattaaaaagaattgggtcggtagagcagaagaaatgcgtaaagaagttatgcaggaaataaaaattatggaagaaaaccaagatgttttactatactactccctacttgagtttagacataagctaatgttggcatatatgtatcctaacgctataaaagacattgagaaaaattatggtgagttaaaagcatatgaaggccatgaaaacttaacaggaatgctcgaatattactattattttttcatgggcatgttctattttagacaaaaggagttggcattctcccttaatcactatagacaagctgagagatatttggattcaattgagagcgaagatattgaagttgaaaaagctgaattttattttaaattgtcagaagtgtattaccacatgaaacagacttatttttcaatgaattatgccatgagggcttacgatatatttaaaaagcaacctgttattgacggtaaccctacatacggggtacaaaaggtacgctgtcaattcgtcatatttggtaatttattggacagtatgaagtttgatgaagctttaaagcaagcatacaaagcgtatcaggaagcagtagagctaaacaaaagtgaaaagaatcgtgggcatttgatgcgttcagcactgtttaatattggattatgttataatcaaatggaagaacttgataaagcattttttcactttaataagtcacttcaaatcattgagccggtaaatcatgattacgctgctaaaacattatttgttatctccttcttaaagggaaggcaaaatgacattgaaaacacaaaaaaattttatgaacaggccaaacagttggctgaacggcataacaatgaaatggtacttgaaaagttaaaaatggttaaaggacttttcttggactatgatttagacttagttaggaaaacattcgagttcttcaaagaaagaagtatataccctgacatggaaagctatggtgtctctgtagcagattttctcactggaaaacaggatgcttggggtgcagttgaattttatcgtttagcaaatgaagcaagaagacaaatcaaaaggggagaagcaatatgaaaactaaactatttatctgtgcagttctattattcggcgttgccggaacagtgggtgcttcctatctccaacaacaaaatgatacgttcaaggttgctgaaagagccgaaacgtaaaaaactaatgactttgtaaggagaacagagggagttgctctctgttctcatgatttatgtccacccgtcaatcctgctctatgcaatgctgttcctccaggtgtataagaaacagctcgtaagatcgcttttgatccgtatttatttcttatcccgtccataacaaatccaagctttcttctcttctcattatctttttcaaacagacttaattgttgatttacatcatcttcaatattggataaggtaactgaaacacttcgtaccgttttgcctatatagaacttatcaaataacatcaagcaatttcgataaatatccattgtgatatttgtaggtaaatcaattgttttagctctgtgaaagccacccccgaactcatctttactataaccaattcctaagctgatcgtacgccctactttattatgtgtccgtgctcttcgtgcaacctcttcacaaatctccaagagaaccgcctttatgtcctctttcttcgtatagtctctaagtaatatctgacttttcccgtagcttatttgcccctgcatcaaaggagctccaatttcagaaaggtcgattccatgggcatgataatagtaggataagaacccgacgccttggcatattactatgctaggtttccaaatgctctcccccaaaccgtacgtacgcctctcagcgtatacggctttccacttgtcagtttagtttcccattgtgtaagtccctatgacagtctacacataaagcaagagttttcctttgtcttgcaatcatgtgttgttcccataaggtcttaccttttaagtctttaagttttctaacatgatgcatttcaatcgctacatctgcttttccgcagtattcgcattttttagcgctcaatctgtcgattagactcgttctcccaacataccttacgaaattcggaagcgtatcgcaccttatgtctgcttcattatccactcgtttaaaaccttctctatagaaataccttattttcgttcccgccttagttttataagcaatccccaacttcccattcagcctgaatcgactatatatgcttgcaacggacgccttatacttagccccaagggttctaagaaagctgtatttcataaaataatagaaatcattcagtgtgtgaacgttatgagcgagcttgtaatagttgtacattcctcggatttccgagttatacatgttgatgatttcaaggtcatcgtggtttataaggtatgtcctatgagcagccttccattttccatcggcggtgattttgagagctttatattcctttagtttattaatccacttttcagccggcatatagagtttacatctaagattttgtgttttcctaaggttcccattcttgtctgttttggtatgtgaacttctcttgatttgaatgtcatatcctaggaatctcgctttttttgaactgtttgtgattagtgtcttttcttgggacagatttaatttaagatttttatttagaaaaaccgtaaggtcttcctttatcttcaaacagtcctttttgcttccgataattccaactatgaaatcatcggcgtacctaacatattgtattcgtttataattcgtgtccataggatcagcaaaatcaacagctaaaagtttctgtttcagcgacttgtacgttctcagctcttctctttttctctctaaaggtagttcgtcccagcacgctttaagtttttttctgtgtttgtaaactagatactcacggcgcttgtattccttgtttgttgctctttttttggctttattgaaaccactagcatagtccctcaggtacttgtctaattcattcaaataaatgttagacaatagtgggctgataattcccccttgcggtgtcccactataagtggagtggaatttccagtcgtttataaagccagctctaaggaatttccatataagcctaatgaattttgagtctctaatccttttcgccagaatactaattagcgtatgatggtcgatgtgatcaaagaaagattctatgtccccttcaataaaccaccgcacccctgtaaagctgtgttttacttgtttaagtgcagtatgacaactacgattcggacgaaagccatgagaactgtcttggaacgttccttcatatatcgcttctaagatcattcgtacaacttcttgtacgagcttatcgtcgaaagatggaattccaagtggacgcttctttccattggattttgtaatataaactcttcgagatggtttaggctggtaagtttcatttttgagtgaatcaattaacgaatcaatgcgtttatgactaaaaccgtcaatagtttttccgtccgatcccttcgtcatgttacctggcttagcatatattttggcataagcctttaggtaaaactcaggattatagagattcctataaagacggtcaaaaacataattttcttctttagacttggaaactaaattgttcaacactacgtctggacttctcacagagcctcgcgctccttccaatgttgtattaaactagacaagctgtctcccttcgccatgtagcaggctttccctaccccagactactacggagactccgttaccttgtcggatattcaggatcgatatccatagcctatatcaggcattccgatttaggtaatccccatttagacatatgttgacatagctttatgcggtgtcggatgtgacgttcgccctttaacccttatcgggattgtccagtcattgagttgcttagagaaagctcaactataattcttcctccctatgactgtataacgttaatggataccttccgttatagacggtagttttgacgactcggactgtcattcaagcagtgtagctttcatccttatccacatatctcatcttgccattcagtcgtgacttggtatctagccaacttatgacttttccaacatgctacactccccgttcagtttccttcccggataagttggatgatgacagatcgttgcaacttaatctgttgtcttgctatcgacaaattcaaacatatgcccttatgggcgcacaagctgattgcccatgatgccgaagcgtttttcaagcagctctagtggatatttagctaattggccaacagttaatatccccatccggtttaaattcctctccatcctccctcctattccccacatttcagataacggatgaacacaccaaagctttttaggaacatcttcatatctccaccgtgcaatcccagtctttgttttcttgctctctaaatcaagagctaacttactcagtagcatattgtcaccaataccaacagtacaaactaagccaaactctctcttcatactgctctgaattgcttctgccatgacttcaggattttcttttcctgcatctaaaaaagattcatcaattgagtacgtgtgcacacatgtttcaggaacgaacctgtaaaacaatttagtgatttcagttgaaactctgatgaaaagtttcatttgcgggtttactatatgaatttttggatcatctggaatctcaaataaccgggagccagtcttgattccataatcttttttaagtgcaggagacgctgctaagacaacacttccctgtctatccgtgtttccgactacagcgagataacatgtcattggattcaatcccattgttacagccattcgctaaatatagcaagtgtttttttcattttatttaaaaacataattcgttatattcatatccgctgcggcataggatgtaatcaagcatggacaagataaggaggcgtcatcagtgaaccacttctacgtgtggcacatcaaaaggataaaacagctgcttattattatcattgccgcatttgcagcagccagcttattttatatacagagagccgtccctcttcctgtatttttaacggataacggtccgaaggcgatttctaaaggggagacgaaagcaaacgaagtcgcattaacatttgacatcagctggggcgatgaaaaagcggttccgattctgaacacgctaaaagcaaacggcataaaaaacgccactttttttctgtcagcttcttgggcggagcggcacccggatacagtggaacgaatgattaaagacggacatcaaatcggaagcatgggatacgcgtataagaactataccaacctagaggaccaagacattaaaaaggatatcctccgggctcagaacgcatttaaaaaaatggctgtaaagaatgttcatttactccgcccgccgaccggacaatttaataaaaaggttcttaccattgcacagcagtaccactattcagtggttcattacagcattaactcacacgattggacaaatcccggccctgataaaatcattgaaaatgtaaacagtcatataaaaggcggcgacattgtcctgctgcacgcctctgattcagcaacacaaacggaagaagcgctccccgccatcattcacaatttaaagcaaaaggggcttaaaaacgtgactgtcggtgatctgatcgcaaatactgacgtcaaatcatcagaggtgaaataactacctctgggcaaactttggcagcattaacagctgaaacgcattgcagcccatcagcgggatcagcatcaaataaagccagtcctcattattcactcttaacgcaggaacccattcaagcgctgtaataacgaccattaaaaataatgatgaaatgaacgtatttcttgaggactgcttttgttttatatatgccgtcaacaggcccacggcgagcaaagccagcggcagccagacaaaccctgcaatcgagtcatcccgctcaccgaaaaataaaaatctgacgtacattaaatcaaaagcaacaaacagaatgataaacagctgaagcagattccaaagcgaactcgatctgaggatttcaagggcaaaccggtgcaccgtcaaaaacacgaagaatcccatttgactgatcacactgaaaatcatgcctactccgataaaccagatcagaacggagaaaatctgtccggcctcaaaattcagaaagaaccccttgtactccccccacttcagtgcaaatcccacgacgcttgtaataagagcgcccacagctaaaatcgaaaagaaaaatcgaacaagcccgcggcttttcatctcttattcatccccctgacaatcgcgttcagcgatattttgttatgtataaatccattccgatgaatcatattaaaagtaagaacaagtaaggaaggagcttatgtatgtcaaaagccaaaacgctattgataagctgttttgttgtgttatctgtaacagcttgtgctccaaaagaccaagcagcggatatggattatgaccagactaaaaaaatggttgtcgatatattaaagacagatgatggaaaaaaagcaattaaggaaatattaaatgatgatgcgatgaatgaggcattggtgattgatcaaaacgccattaaaggcacgatagagaaaaccctcacctctaaaaaaggggcggagttctggaaaacgatctttgaagactcaaagttcgccgaaagctttgcaaaaacacttcagcccgagcacgaaaaaatcataaaaaaactgatgaaagaccctgattatcagaaaagttttatgcagatcttgcaggaccccggcatggataagaaatactacgagctggtgaaaagccaaaaatttcgcagttacctagaagatgtgattacagagacactttccagcccgcttttcaaaaagcaatttgaagatgaactgaaaaaagcggcttcaagctctgaaaaagaaagccaataaaaggccgggccgtattgatcccggccccttttttattcagccgttttttcaatgactttttgggcgatgcccatataaatttctccgatcggatggcttctgtcgtagacagaaggcgcaaactggtctttgtcccaatcaggctgctttaaaggaattctgccgagcagcggcacctgcaattcttccgcaagcttatctcctccgccttgaccgaacacaaattctttttcaccggtttttgcactttcatagtaagccatgttttcaatgacccctacaacttcatgatcggttttaattgccatagaacccgctctcgctgctacaaatgcggctgtagggtgcggcgttgttacgataatctctttactgctcggaagcatcgtgtgtacatcgagcgcaacatcacccgtgcccggcggcagatcgagaacgatatagtcaacctctccccagtcaacttcatggaagaagttgttcagcatcttgccaagcatcggtcctctccaaacaaccggagcgttttcttccacgaaaaagcccatagacatgacctttactccaaatctttcgacaggaagcagtttttctccttctactgtcggacgaacagtaatacccatcatgtcaggcacgctgaaaccgtatatatccgcatcgatcaggccgacttttttgccgagccgcgcaagagaaatggccagattgacggaaaccgttgatttgccgacaccgccttttccgcttgccaccgccagaaagaccggcggatttttcctattcagcagggtttcgctttcaggcgccggctggctgaatttcgccaatgtctcttccggcagctcttcaaaccgaaggccgacagtttccgctcccgcttctttcaggacggatacaatttcctgctgaatgcccatttgttcagccgtccccgtttttgccaatgcaatttttacactgacatgccgtttctccggcttgacctttacttccttaacggcatccaattctcccagcggtctatgaagaaaaggttcgcgcatttttccgactatatttcttacttcatcttctcttatcatcgaaccctcaccctttgtgtattcgtttacaaatggtattataccatatattaatcatagaatcggcgaaaaaccctccttactcgggagggtctcctttctctgtgaagtatctcaatacgcccttatacacggaagatgcgattttatcctgatatttaggctggctgagccttttcgcttccgcggggttggacaaaaatccgacctccaccagtgcgcccggtttggttacattctgcattaagtaaatgccgtgtatccgcttcgcctttctcgttgtattctccaaattaattctcaattcgtcctgtatatattttgccactttttcattctcttcgtattttccatagtaaaagctttgggcgccgctccatttcggtgacggtatggcgttcaagtgaatgctgatataaagctctgcttctgaacggttgatgatctccacgcgctttctaagatcttccgctttgcgtctgctgtagcctttcatcccttcaggcgctaagtcggtatccgtctcccgcgtcatgatgaccaaagccccttgctcctgcaaatagtctctgactctggaggccacttcgagcgtaatatccttttcaaggtgattgcttcccgtggcgccgccgtccggcccgccgtgtcccggatcgagatagatgatttttccgctcagcggcagactccacggccgccaggaatcatcattatggaattgaaaccggaataaacacaataatatgataaagccaagtaaaaaaccgagccatttcagcttatttctcatacctttccctcccgcttgtccccgttattaataagtatgggacatgggaagaaattatgattacctcatgcggagcttacattgttttttccgttgcagaaacccttccgtccaccagctgttgataaacctgcatgacgcttcgtagatttctttttgttcaacggaagaatattgctcatgcgtccagctgcaaagatattcaaaaaaatcgaccgtcagttcttcctcctcttcggacgaacgggcgtttgccctttgcaaagactcaccgtaatagccaaagacgccgaaccggccgcctaataaatacgcttctattgcaaaatctatgcacccttcacttagaatgccgttttcatcttggagaaagggaaacaaaggggaaagacatgcttttacggattgaatgatctgcgtcagtgacagctccttgagtaaattcttctcaagttcaaaatccttctgccgtttcacgtctgaaaaagataatacctctgccattgccattcacgctcctttttactgttattttgaaaggaaaaagggaaaagcatgctttgttgatagtggaaatcctcccaaatgaaggggttccatgtttaaagggcagagacggtgttgtgaaaatgctgttacagcacagtcggcaggtgcttgatgagaggctgagcggaatcacagacaagcgcgacccgcaaaaaaacagcacctctgacgggatgctgtttttatattttaatgcttcttgttacggagtatgtattaatgtattcatccaggacgaggccgcccttgtcctcataaaagccggtgaccatgaagcccgcgtcaatctggcccttaatttgatcctctaacgtatggccgaattccagcgcttcattattgtcaatgagttcctttacttttttcttactgagatccttttcatccgaaaacggaatggaatactttacttttaggacgccctcctgctctaaatccatatcaaataaaaacacgacgggatttacaaaaccggagactaaagatccgcctttttttaatacgcggtgggcttctttccataccgggagcaccgtatcaacaaagcaattcgatactggatgcacgataaaatcaaatgactcatcctcaaaacagctcagatcattcatgctgcctttgacagtccggagcgtaagatcttcccgctcagcaaccattctgtcttgcgcaagctgtttttctgaattgtcaaagacggtgacatcagctcccgcagcagccagcaccgggccttgctgtccccctcctgaagcgaggcaaagaaccttcagaccatcgatgggcgggaaccaatccgccggtacgtcttttcccggagtcattctgatgctccaactgccttttttcgctttgccaatcgtatgtgaatcaaccgcaaccgtccactcattgccaatttcgacttttttatcccatgctttgctgttatgtatggctaacttattcattataactgcgctccttattgttaatgaatagagtataacaaacaattctagaaaaacattggataacctcttggatttgagaaaaaaatacaaaaaaaccacaaccaagaagttgtggtttttgcaatccaaaacgattaacgttttgagaattgaggtgcacgacgagcgcctttaagaccgtattttttacgttctttcatacgagcgtcacgagtcagaagaccagcacgtttaagtgttgcacggtattctggatctgcttcaagcaaagcacgagcgataccatgacggattgctccagcttgaccagataagccgcctccatgtacgtttactaaaacatcataagtaccagctgtttcagttaaagttaatggttgtttgatatcttcgattagagctggcgatggaatgtgctcgctgatttcacgattattaacgacgatacgaccttctcctggaactaagcgcacgcgcgctacagaacttttacgacggccagtaccgtaatattgaacctgtgccaaattggtaacctcccttttaattaaccgcgaagttcgtaaacttcaggctgttgtgcttggtgtggatgctcagaaccacggtatacgttcaatttcttgaacatttgacgacctagagaacctttaggaagcatgcctttgatagcaagctcaagcattttctcagggtagtttgtacgcatttcaagagcagttcttgatttcagaccgcctgggtgcatcgtgtgacggtagtagattttatcagttaactttttaccagttaactcgattttttcagcgttgatgatgatcacatgatctccagtatcaacgtgcggtgtgtaagttggtttgtgttttccgcgaaggatagatgcaacttctgtagaaagacgtcctaaagtcttgcctgctgcatcaacaactaaccacttgcgttcaatagtacttgcgttagccataggtgttgtacgcatttaattccctcctaaatgatctgtcattttttcataaacttctgttacgttctatttcacaacacaataagttccggggcttatcgtggggttgaaatacataccatatgatatcttataactttatgcagactctgtcaagaaaatgttacacctggtttagttgtcatagcaaacgctccataaatacagcccgtgccccggtgcggtgcgccccgcggcttcgcgatccttcgcttccagcattgcttttacgtcatcaggagaaaattttccagcccctgtgtctaataacgttccggcaatgattctgaccatattatagagaaatccgtttccggtaatccgcatttgcaggccgtctccggtctcagtccattccagctcgtaaatcgttctgactttatcctgaaccgcggtatcaaccgcacaaaagcttgtgaaatcatgtgtcccgatgaggtgccttgaagcttccctcattttctgcacattaagctgatatgcaaaatggtaagcgtaatgtcgtttaaatacgtccgggtgtttctccgtgtatacaaagtagcgatattccttttggactgcgctaaatcgtgcatggaacccatcatccgcaatctctgctgttttgacggcaatgtcatcaggcagcagggcattgagcgcaaacggccatttctcagccggaatggacagcggagtatcaaaatgaatgacctgtccggcagcatgaacatcactgtcagtgcggccggatgagtagacaggcactctgccgtcggttttatggatgacggccagcgccttttccagttcactttgaacggtccgttttccaggctgaacctgatatccgttaaataaatgcccgtcataagcaatggtacatttcattctcattgggcagcacctctaacttcttaagaaaaacaataatacggctaatacgatgatgagcagaatagctccggtatccttgccggtccagacaagctttctgtatttcgttctcccctcaccgccctggtagcctctcgcctccatggcgaccgcgagctcttccgcacgtttaaaggcgctgacaaacaggggaacaagcagcggaacgaccgcttttattctgtctttcaccgggccgcttgtaaagtctgcacccctcgccatttgcgccttcatgattttatccgtctcttccatcagcgtcggaataaagcgcagcgatatcgacatcatcaatgcgagctcgtgtacgggcagcttcacctttttaaatggatgcaggagctgctccattccatccgttatttcaatcggcgttgtcgtaagcgtcagcagcgtcgtcataaaaatgaggtaaacgaaacggagagagataaaaatcccctgtacaagtccgccctcataaactttaaaccagccaagccgaaaaatgacagcaccctcatgcgtcatgaagatgtgcagtaaaaacgtaaatgccacaatccagataatcggcttaagccccttcagcaaaaagctgaccggcactcgcgtcaaggcgatcaccccgaatgtaaacaaaccgagcaaagcgtacgtctgtacgttgtttgccaaaaaaacgatacatacaaaaagaaaaatgctgacaagttttgttcgcgggtctaagcggtgaataagcgatgatccgggaacatactttccgataatcatgctgtccatcattggtccttatcctcctgaaagaaagccttaatttcaccggcggcatcctgcagggtgagcatgggtttctcatacttgactccgagaaccgcctcaagccgtctctgaaacttcaccgattcaggaagatccaggcccatttcggccatctcttcaccttttgcaaacaaatcactcggactccccgtcgctttaatcgttcctttgtgcatgacgatcatctcgtcggcatagcgggcggcgtcctccatgctgtgcgtgacgagaacggtagtcaggtttccccgctgatgaagcgcatagaacatgtccataatgtcctggcgccctcttggatcaagcccggccgtcggttcatctaaaaccagtacttccggctccatcgcaagaacaccggcgatcgccactctgcgcatctgcccgccgctgagctcaaacggcgaccgttccaaaatgtcttccggaagacccacaagctccagcatctctttcgccttccgttcagcgtcttcttttttcacaccgaagttcattggtccgaatgcgatgtccttcagtacagtctcctcaaacagctgatgttcgggaaattggaaaacgattccgacttttttccgcaaagccttaagatctttattctttttaccggctgctaaaatcgtgctgccgagctccagctgtcctttagtaggcctcagcaaaccgttcaaatgctgcaggagcgtcgatttacccgatcctgtatgcccgatgacggcaacgtagctgccctctttgatcacggcattgatatcatacagagcaagccgttcaaacggtgtctttatttgataacgatgttctacatctttgattttaatgtccacagctcattcaccagcccttcctgagtcagatggtttttcgataacgccagtccgctttctttcaaaagcaggctgagctggaatgagaaaggcaaatcaagaccgatgcgaaccaagtcttcatttaatttaaaaatctcttcaggcgggccctctgcatatttcctgccgccgttcattacaatgatcctgtccgcccttgcggcttcttccaagtcatgtgtaatcgaaatgacggtggccatgccttgatcttttaagcgtctgacagtatcaaggacttcttctctcccgatcgggtcaagcatggatgtcgcttcatccaaaatcataatatcaggacgcgcagcaataatccctgcgatcgccactctttgtttttgacctccggagagatggtgcggctcttgatcaagaaaatcctgcatattgacttgtttgacagcccaatctactctctcaatcatttcttcgcgcggaacaccattgttttctaaaccaaaagccacatcatcgcgaaccgttgttccgacaaattggttatcgggattctgaaagaccatccccattttttttcgcacatcccaaacagtatcttcagtcagtttcatgccgccgacttcaatatctccggcctcaggcaaaatcagtccgttcagcgctctggccaaagtcgacttccctgaaccgttgtgacctacgatagcaagccattctccttcgtatacctccagacttacaccgtccagcgccggcctttctgcatctttgcggtatcggaataagatgtcttttacggatataagctgtttttgatccacgggcgcctgacctcctctcagctatagctctgcttttctgtctcatgataaaaagttctggtatctaaaaaaagggcatagatccagttagaaactgtcccgcccttctttagatacacaaaaatatgtgattaaaccaattcgatgattgccattggtgcaccgtcaccacggcgaggaccaagcttcataatacgtgtgtatccgccttggcgctcctcgtaacgagttgcaatgtcagagaataatttttgaagtgcatcttggttattttcttcattagcaacctcgttgcgaatgtatgcagcagcttgacgacgagcatgcaagtcaccgcgtttaccaagagtgatcatcttttcaacaacagagcgaagttctttcgcacgtgtttcagttgtttcgattctttcgttgatgatcaaatctgttgtaagatcacgaagcatagctttacgctgtgaactcgtacgtcctagttttctgtatgacatgtgatgtcccctcctttaatggaatgctgtttctaattaaaaaacacacgaaaatcctagttcacatggaaactagatcaatcgtctttgcgaaggccgagtccaagttcttcaagtttcgctttcacttcttcaagtgatttgcgtcccaagttgcgaactttcatcatatcttcttccgtcttgttcgcaagttcttgaaccgtgttaatgcccgcacgcttcaagcagttgtaagaacggacagaaagatcaagttcctcaatcgtcatttcaagaactttttctttttgatcctcttctttttcaaccatgatttcagcatgctgagcttcgtcagttaaaccaacgaatatattaaggtgttcagttaaaatctttgaaccaagagcaattgcttccttcggtccagtgcttccgtcagtccaaacatcaagtgtaagtttgtcatagtttgcaacctggcctacacgagtgttttccacctgataagataaacgggaaactggcgtaaagattgaatcgatcggaatcacgccgattggctgatcgtctcttttgttcgaatcagcaggagtatacccacgtcctctttgtgcagtaaggcgaactcggaaactcgcattctcaccaagagtcgcgatatgaagatccggattaaggatttcaacatcgctgtcgtgtgtaatgtcagctgctgtgacagttccttcaccctgtacatcaatttcaagcgtcttctcttcatcagagtagattttcaatgcaagctttttaatgtgcaagattatcgttgtaacatcttccacaacgccttcgattgtcgagaattcgtgcagtacaccatctatctggatcgatgttacagcggcaccagggagtgaggataagaggatacgacgtaaggagttacccagagttgtaccatatccacgctcaagcggctctacgacaaacttaccaaatttggcatcgtcgctgatttcaaccgtttcgatttttggtttttcaatctcgatcattacttaaaaccctccttcaaaacgtcgaaacctcgaatagaatcatatgagattccatccgaaattccccattgtttagtcccgtatgtgctcaggcaacgagtcggtgcattcgtttcataaataactgtatcataacccattattgacagggacacaaaatctatacaaacaaattacacgcggcgacgttttggtggacggcatccattatgaggaacaggagttacgtctctgatagctgtaacttcaagtccggcagcttgtaaagcacggattgcagcttcacggccagaacctggtcctttaacagttacttcaagagttttaagtccgtgttcgattgaacctttagcagctgtttcagcagccatttgcgcagcaaaaggagtagatttacgagaacctctgaatcctagagctccggcacttgaccaagaaatagcattaccatgagtatcagtgatcgtaacgatcgtgttgttgaaagttgaacgaatatgagcgattcctgactcaatattctttttcacgcgacgtttacgcgtgttttgtttacgagcagcagccattgtttaggtacctcccttacttattttttcttgttagctacagtacgacgcggacctttacgagtacgcgcattgtttttagagttttgtccgcgaacaggcaaacctctgcgatggcggattccgcggtagcttccgatttcgatcagacgcttgatgttaagagaaacttcacggcgaaggtcaccttctactttcagtttgtcaataacatcacggattttaccaagttcttcttcagtaagatcacgcacacgagtatcttcagaaacaccagcctctttcaagacttgctgagccgttgtgcggccaattccgaagacatatgttaaagaaataacaacacgtttgtcacgtgggatatctacaccagcaatacgagccattctctgggcacctccttattaattatccttgtttttgtttatgctttggattttcacagatcaccattacttttccttttctgcggataactttacatttctcgcagattggtttaactgatggtctcactttcatgtgtttccaacctccttcagtttccggagtgctttatttgtaacggtacgtaatcctgccacgagttaagtcatatggagataattctaccgtaactttgtctccaggtaaaatgcgaatgaagtgcatgcggattttaccagatacgtgagccaaaaccgtatggccattctcgagttcaactttgaacatcgcgtttggcagtgtttcgactatcgtaccttccacttcaattacatcgtctttcgccattcaagtgttctcccttcttcaaatcagtaacttgctctctgacaaatttcaaaagagaaaatctcagttatccgtttgtcacacgccctgtttcgtttatactgttctgaacttccggagatacgcaatcataaagggtaaatgattgatattctttttctaaggagaatgaaatgtacgcttttctccgtctgctttagtacatgatgaagaatcttcattccgatgacagcagctagccggtttttcctccgaccaattgtacttctacaatctgcccaggtgcggaatgaaaaacatgtgtcatggaattcatttcatcatctagacttttgtcagtatatcaaaacccgtttccgtaatcgcaatcgtatgttcaaaatgagcacactttttcccatctaccgttacaaccgtccagttatcagtcaatgttttcacataccggctgccagcgttaaccatcggttctatagcgagaaccataccaggcttcagcctaggtcctttgtttggcggaccgtaatgaggaatttgcggatcctcatgcaagtcttgaccaacaccatgtccgacatactccctaacaactgaaaactgctcattttcgacatacgtttgtattgcgtgggaaatattcgacaaacgttcacctggttttgcttccttcaagcctttatataaagactcctctgtcacttccagcagtcgtttatcatcatcactgatgtttcctaccggatatgtccaagcagagtcaccatgataaccatttaatttagcaccgatatcaatgctgataatgtcaccgtcgcgcaaaacccttttgccgggaattccgtgaacgagttcttcattaactgatacacagatgctcccgcgaaacccattataccccttaaaagatgggattgcaccctgcttctcaataaaacgttcggcaatttgatccaattcttttgtcgagattcctggtttaatgtgctttttcaactcttcatgagtcaaagccacgattcgccctgcttcccgcatgatgctaagctcacgaggggtcttacagataatcatttgctcaatcctccaagaagctccttcacatctttgtacacgtcattaatgtcctgctggccattgacgttgacaagatatcctttctcggaataaaaatcgagtaaaggctgagtctgcttcatgttgacctcaagccgttttgagacggtttcctcattatcatctgcccgttgataaaggtctcctccgtctttatcacaaacacccggcgttttcggcggattgaaaaccaaatgataggttgtgccgcaaacactgcaaattctgcgtccagtcaaacgttccattaaagagtctttgtctactttaatgttaatgacataatcaatcggcttgccgtattcctcaagaatgtcttcaagagcttcagcctgagcgactgttcgcggaaatccgtccagaagaaaacctctttcacaatcatctttgccgagtctttctttgacaatgccgattgtgacttcgtccggtacgagctcgcctttatcaatataagactttgcttcgagtccgagtggtgtttcttctttcatagcagcacggaacatatctcccgttgagatatgaggtatcccataatcctcaacaattcgttctccctgtgtgcctttaccggctccaggaagtcccattaagactaagttcattcggatttcccccgtcctctcttatttagaggaatggttaaaaccagtcctctaatttttcataaatcctcggtaattacgtttcactaactggctctccagctgcttcattgtctccaaggctaccccgacgacaattaacaaagatgttccgccaatctgtgcactttgaggcaatccagcgaattgaatgaaaaagataggaagaatggaaatcacggctaagaatatagaacccacaaacgtaagtcgatacaaaatgctcgtaattctatcttgagtcattttccctggacgaacccccgggatatagccaccctgttttttaaggttatcagccatttgttcagggtttacctgcacaaaagcatagaagtacgtaaaggcgataattaatgcgacataaaccgtcatgcccaccggatgtgtattgtcaaagttggcttgaatccactttgtcacatcgtttgttccgaaaaatgacgcgatcgtacgcggcgtaataagaaacgcaacagcaaagattaccggaataacccctgcaggattcactttaagcggaaggtgagttgactggcctccgccaacaggtgaacgaccttgcccttttgcatattgaatcgcgattttgcgtacggcctgctgaatgaaaataacaccaacaataacggctaaaatcgcaatcaccagtaaggcgatttttacaatatgaataaacagctgatcgctgctgccgacaaattgagtctcataaatctgcccaacagttttcggaatactagccacaatccccgcgaagatgatgatcgaaattccgttacctactccattggaagtaatttgttctcccagccacattaaaaaagcagttcctccagtgagtactaaagcaataatcagatatgtcgatatgccggatttttcaatcagcataccgtttgccaggttgttaaacccgtatgacatacctaacgcctggataaaaccaagcacaatcgtaaaatatctcgtgaactgagctaatttacggcggccgacttcaccttgcttagaccactcagtaaacttcggaacaacatccatctgaagcagctgaatgatgatcgaagcggtgatgtaaggcgtaattcccatcgcgaagatagagaactgataaagcgcaccgccgccaaatgtattaaggagatcaaaaacccccatcgaactttgtgtctgtaacgcctgagcattaacatatggcacagggataaacgcacctatgcgaaagacgataagcatgagtaatgtaaaaatgattttattccgaatatcactcacacgcataaagttggagattgtcttaaacaagttagatcacctcagctgtaccgccagcagcttcaacagcttctttcgcagaagcagagaatttattggcttttacagttaattttttctctaatttaccgttgccaagaatctttactcctgcattaagtttgctaataacaccagtctcaagaagaagttcaggagtgacttccgttccttccgcaaaaccgttcaatttgtctacattcacaatcgcgtattccttacggttgatgtttgtaaaaccgcgtttaggaagacgttggaataaaggcatttgtcccccctcgaatccagggcgtacaccgccgccagaacgagcgttttgacctttgtgacctttaccagctgttttaccgttaccagaaccaataccacgacctacgcgattgcgcactttgcgtgaaccttctgaaggctttaattcatgaagtttcattaggacacctccttagcctatagtttatttttattgttctttaacagaaactagatgagatactttattaatcataccgcggatcgcagcgttatcttcatgaacgacagtttggttcgttttctttaaaccaagtgttcttacagtaacgcgctgatcttccgggcgaccgattacactgcgtttgagggtaatttctaatttagccattaatgttccctccttatcctaacagttcttctacagattttccacgaagcttcgcaacctcttcggcacgtttaagctcacttaaaccttgaagtgttgcacggatcatgttgatcggtgtgttagaacctaaagacttagaaaggatatcagcaacgccagcaagctcaagtaccgcacgtacagggcctccagcgataactccagtaccttcagaagcaggtttcaacaagatattgcctgcaccgaaacgtccgatgatttcgtgtggaatcgtagttccaaccattggtacttcaatcaaattctttttcgcatcttcaacagctttgcggattgcttcaggtacttcttgtgctttaccagtaccgaaacctacgtgaccgtttttgtcaccgacaacgactagagctgcgaaacggaaacgacgaccacctttaacaactttcgctacgcggttaaccgtaactaagcgttcttctaactctaatttgcttgggtcaatacgacgcataatcatgtgtccctcctttttttattaaaatttcagtccggcttcacgagctgcatcggccagagcttttacacgtccatggtataagtatccgccgcggtcaaatactacgtcagaaacacctttctcagaagcgcgtttcgcaacgagttcaccgactttagcagcagcagcgctgtcaccagtgctttccacgttcaaatctttgtcgagagtagaggcactaacaagtgtaacgccatttacatcatcgatgatttgagcataaatgtgtttgtttgaacggaacacattcagacgaggtctttcagctgtgcctgaaagtttagcacgaacacgagcatgtcttttttgacgagcagcatttttgctagttttcgtaatcatcctaggtcactcctttcttcactttaagcggtcttacttagcagatttaccttctttacggcgaacaacttcaccttcgtagcgaattcctttacctttgtaaggctctggagaacgtacagcgcggatgttagcagcgatagctcctacacgctctttgtctgtaccttttacaactacttttgtttgagaaggaacttcaatttcgatgccctcttcaggaacgatttcaacagggtgagagtatccaacgtttaaaacaagtttgtttccggatttagacgcacggtaaccgacaccgactaattccaaacctctttcaaatcctttagatacgccttcaaccatgtttccaagcagactgcgagtcgtaccatgcaacgcacggtgctctttatgatcagaaggacgagtgactgtaagcacgttgtcctcaattttgatttccatatcaggatggaaagtacgagttaattctccttttggtcctttcacagctacagtgttgccttcgttcagcgttactgtaacttcagaagggatctcaagcagtttcttacctacacgagacatactaaaacacctccattctttgttaaacttcttaccaaacgtatgctagaacttctccaccagcttgttttgcacgggcttctttgtccgttaaaacaccttgtgatgtagaaataatcgcgattccaagaccgttaagtacgcgaggtacttcatttgatttagcgtatacacgcaaacctggtttgctgattcttttaagaccagtgataacgcgctcgttgttttgtccgtatttcaagaaaacgcggatgataccttgtttgctgtcttctacgaactcaacgtcacgaatgaaaccttcacgctttaaaatgtcagcaatttctcttttcaatttagaagcaggaatttcaagcttctcatgacgtaccatgtttgcattacgaatacgagtcagcatatctgcaattggatctgtcataaccattatataattacctccttccctttcttggggattaccagctggcttttttcacgccaggaatttgtcctttatatgcaagctcacggaaacaaatacggcaaagtttaaatttacgaatgactgagtgcggacgtccgcagcgttcacagcgagtgtactcttgcactttaaactttggtgtacgttgttgtttcgcaatcattgactttttagccacgatttcgcctccctttcattgattatttctggaacggcatacctactagagttaatagctcacgagcctcttcgtcagagttagcagtcgttacgataacgatgtccattccgcgaacctttgttactttatcgtagtcaatttcagggaagattaactgttctttgataccgagagtgtagtttcctcgaccgtcgaaagatttcttagaaatcccgcggaagtcacgtacacgcggtaaagatacagaaataagtttatcaaggaaatcatacatgcgctctccgcgaagagttactttcgcaccgataggcattccctcacgaagacggaatccagcaattgatttcttcgcacgagtaacgacaggtttttgacctgcgataaacgttaattcttcaacagcactgtcgattgctttcgcgttttgaacagcatcaccaacacccatgttgattacgattttttcgattttcggcacctgcataacagagtcgtagttgaacttcgtcattaaagcaggtgaaatttctttattgtacttttctttaaggcggttcatgagatagacctcccttcctttaaatactatttatctaaaacttgcccagattttttagcaatacgaacttttttgccatcttccactttgtatcctacgcgagtcacttcacctgttttaggatcgagcggcataacgtttgatacatgaattggcgcctcttgattagaaataccgccttgagggtttgcttgagtcggtttagagtgtttcttcaccatgtttacgccctcaactagaacgcggtcctttttagggaaagcagcaaggatcgtaccttgtttgcctttatctttaccagagataaccattactttatcgccttttttcacatgcatcctgatcgcacctccttgagtaaggcatttatttcattagataacttctggagccagagaaacaattttcatgaagttgttttcacgtaattcacgagcaaccggtccgaagatacgagttccacgcgggctcttgtcgtcacggatgataacacatgcattctcatcgaagctgatgtatgatccgtcagatctgcgtgctccgctttttgtacgaacgataacagctcttacgacttcaccttttttgacaacgcctcctggtgttgcttgtttaaccgtgcaaacaattacatcaccaatgttagccgttttacgtccagaaccgccaagaactttaatagtaagtacctcacgcgcaccggagttgtcagcaacttttaaacgagtctcttgttgaatcattatttgttacctcccttcggaaaaaagaattccgaactttattagataataacagcttcttcgacaacttcaactagacgaaaacgcttagttgcagataatggacgagtttccatgacctttacgatgtctccgattttagcttggttattctcatcatgtgcttttaatttctttgagtattttacgcgcttaccgtagataggatcctttttgtatgtttcaacaacaacagtgatggttttatccattttgtcagaaacaacacggccttggtaaactttgcgctggttacgttcgctcatgctcacgacctcccctcagtgattatttgttagcagcaatttctctttcacgaatcacagttttcatgcgcgcgatagctttgcgcacttcacgaatgcgagcagtattttcaagttgtcctgtcgctaattgaaagcgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaagacgaagcgcttcacgagctacctcttcagacacaccagaaatttcaaataaaactttgcccggttttacaacagctacccagccttcaggagcccctttaccggaacccatccgtacctcaagcggtttagcagtgtaaggttttgaagggaaaattttaatccaaactttaccgccacgtttcatgtaacgagtcatcgcaatacgtgcagcttcgatttggcggtttgtgatccaagaagcttcaagagcctggataccgtactcaccaaaatgtacttcagtaccgcctttagcgcgaccgcgcatttttccgcgatgctctctgcgatatttaacgcgttttggtaataacatattattttcctccttcctcagttttcttcttagtaggaagaacctctccacgatagatccagacttttacaccaagcttaccgtaagttgtgtcagcttcagatgttgcatagtcgatgtcagcacgtaaagtgtgcaatggaacagttccttcactgtagtattcagaacgagcgatgtcagctccgccaagacggccggaaaccattgttttcacaccttgtgctccagcacgcatagtgcgttggatttgttgtttctgcgcacggcggaaagaaatacggttttctagttgacgagcgatgttatcagctacaagctgagcatcaagatctgctcttttgatttcaagaatgttaatgtgtacacgcttgccagtaaggctgttaagggctttacgaagtgcttcaacttcagaaccgcctttaccgattaccataccaggcttagcagtgtggatcgtaatgttaacgcggtttgctgcgcgctcgatttctactttagaaacagaagcgtcagaaaggcgtttgctaatgaattcacgaatttttaaatcttcgtgcaggaagtcagcgtaatctttaccagcgtaccacttagattcccaatcacgaatgactccgatacgaagaccgactggatttaccttttgacccactacttatccctccttcttttctgatacaacgattgtaatgtggctcgtacgtttgttgatttggctcgcacgtcccatagcacgcgggcggaatctttttaacgttgggccttcgtcaacaaatgcctgagaaataaccagattgttagcgtccatctcgtagttgtgctcagcatttgcgatagcagattttaaaactttttcgatgattggagaagcagctctcggagttaggttcaagatagatactgcttcgcctacttgcttacctcgaatcaggtccattactagacgtgctttacgaggagcaatacggactgttcttgcaacagctttagcttgcatttaaaagcctcctctcttagcgtcttgtttttttatcgtcactggcgtggcctttgtaagtacgagtcggtgcgaattcgcccaacttgtggcctaccatgtcttcagaaatgaatacaggcacgtgtttacgtccgtcatagactgcgattgtgtgaccgataaattgtgggaaaatagttgaacggcgagaccaagtttttacaacttgtttcttgtccgtttcatttaatttctcgatttttgtcatcaagtgtccatcgacaaatggtccttttttcaagctgcgagccattttggaacctcccttcgtgattgcactacggtccgaaaagaaccgtagacaaccccgttatttatttttacgacgacgtacgataaatttatcagatttgttctttttcttacgtgttttgaatccaagagtcggtttgccccatggagacattggtgatttacgtccgattggcgcgcgaccttcaccaccaccgtgcgggtgatcgttagggttcattacagaaccacgaactgtagggcggatgcctttccagcgagagcgtcctgctttaccaacgttgataagttcgtgctgctcgttacctacttgaccgatagaagcgcggcaagcagaaaggatcatgcgaacttcaccagagttaagacgtacaagaacgtatttgccttctttaccaagaacctgagcagatgtaccagctgaacgtacaagctgtccgcctttaccaggttttaattcaatgttatgcacaactgtaccaacagggatgttgataagcggaagtgcgttacctactttgatgtcagcttcagggccggacatgatttcagtacctacttgaattccttttggtgcaagaatgtaacgtttttctccgtctacatagttgattagcgcgatgttagctgaacggtttggatcgtattcaactgtagcaacgcgtccaggtataccatctttatcgcgtttgaagtcgataacacggtattggcgtttgtgtccgccaccttggtgacgtacagtcaatttaccttggttgttacgtccgcctttcttgtgaaggggcgcaagcaaggatttttccggctggtcagtcgtgatttcagcaaaatctgaagttgtcatgccacgacgtccgttagaggtcggtttatactttttaatcgccattttgaatttccctccttctttttacagataattaagcttcaaaaatttcgatttctttgctgtctgcagtaagttttacgatcgcttttctgcgacggctagtcataccagtatagcggccgacacgttttgatttccctttgtagttcatgatgttgactttgtcaactttcactccaaagatactttcaactgcatctttcacttctgttttattagctcttacatcaacttcaaaagtatatttcttttcagtcattaaatcagcagaacgttcagtaatgacggggcgcttaagaacatcacgaggatctttcattatgcaagcacctcctctactttttcaaccgcagcttttgtaatcagaagcttctcgtggttgacaacgtctaacacgttgattccgttagcttgaacaactgtaactccagggatgttgcgtgcagaaagagatactgcttcgtttgcatccgcagttacgattaaagcttttttctcaacagataatcctttaaggatagctgccatttcttttgttttaaccgtatcaagagtaagatcttcaagaacaataatgttgttgtcgttcactttagaagacaatactgatttgattgccaagcggcgaacttttttaggtaatttgtaagaatagctgcgtggtgttgggccgaatacgacaccacctccgcgccattgcggtgaacggattgaaccttgacgggcacgacctgtacctttttgacgccatggtttgcgacctccgccgcgtacttcagaacgattttttactttgtgagatccttgacgtaaggaagctctttgcataagaatagcgtcgaatactacgctctcatttggctcaattccaaatacagaagcgtttaattcgatatcaccagcagtagaaccgttttggttgtataatgctacttttggcatgatcaatttcctcctttcctaagagacttatttagatttaacagcactttttacagtgattaaagcttttctcgcaccaggtacgttacctttaatcagaagaagattgcgctcagcatcaacttttacgacttcaaggttttggacagtgatttgatctccgcccatgcgtccaggtaatagtttacctttgaatacacggttaggatctacaggtcccattgaaccaggacgacggtggtagcgtgaaccgtgagacataggtccgcgagattgtccgtggcgcttgattgcaccttggaaacctttacctttagatactcctgttacatctacgatttctcctgcagagaaaatttcaaccttgacttcctgaccaatttcatacgcatccatatccacgccgcgtaattctttaacgaagcgcttaggagcagtttccgcttttgcaacgtgtcctttttccggtttgtttgaaagcttttcacgcttatcgtcaaaaccaagctggatcgcttcatagccatcattttcagctgttttcttttgaagaacaacgtttggagctgcttcaataacagttaccgggataagatcaccgttttctgcgaatacttgcgtcataccaatttttcttcctaagattcctttggtcattcgtcacacctcctattaagatcattctatattttagaattaaagtttgatttcgatatcgacaccagatggtaagtctaatcgcatgagagcatcaacagtttgtggtgttgggttcacaatatcgattaaacgtttatgtgtacgcatttcaaattgctcacgagaatctttgtatttgtgcaccgcacgaaggattgtgtaaactgatttttcagttggcaacgggatcggaccagatacgctggcaccagaacgttttgccgtttcaacaatcttctctgcagattgatcaaggattctatgatcatatgcttttaaacgaatacgaattttttgttttgccattattttccctccttttcgcctacatcacgttagacagttctccgtgagaaaaacctgatcaccttgccatggcaaagcggccgggtgtgtcagcaacctctcacttcatcgcagtcaaagaccaacatacactattatacagaaaatagacgcatgttgcaaggtttatttaaagaaccttgtggttttcacactttgattattatacaggtgatgccatgattaatcaaggatatgcctgttttctttcagagatggaaagatgcgaatcggctgacaacttcagcaaagcgatccggctcttccaagtgaggcgaatgggctgagttttcaaaccagtgccattctttatagggagcttcaaccttctgataatattcgtaagatatcgttcccggcaccgtcaaatcgaatcttcctgacataaaacagcacggtatttcaatagaagaaactgattgcccggcatcaaagaaaatgagatcttcccacaaatgtttcaggctgaacatctgtccccgcgcggctaagaagctccctctcacaccgtacggttcaccaaacagcattcgtccgcctgctttaagggcgccgatcggattatgggtaaagcctcctcccttcatctcgatacaaagcagaaacaatgagcgctgaagctggctgttccatggaggtgcaccgataaagcgcagcgtcttttgtagcaggcggtgtttgcgctcctcgctccaatccgtcagcagccggtaggcttccgtttcttccttttggatatttacaacctgactgataccgatatacccatcatacaaatcaggtctctcttgaagaacatgaagcgccaacactgatccccacgaatagccggcgatatatattttttgcctgttgaattgcttgcataagcgttcggtcaaatgaatggtgtcagctgtcagctgatccaaagtcatagacgagcccggaatttcatttgaatatgaaagtcccgcccctctctgatcccagttcacaacagtgaaatgcttttccagctcgctctggtactttctcgcatagccgatttgaggcgtgccgggcccgccgtgcaaaaacaaaagcagcggattgctcttgtcatcaccattaatcataatggtctgttcactgtcgttaatcagcagttgctgaagcattgaaatccgttttgtcttgaagttatcaatcatcgctctgctcctaaattttgtataacttctattatacattgaatcagccgggaaacaaaaaaacgaggccccgcatgggaccccgtattaatgaacgagtcgattactcagtgattgtagaaacaacgcctgaaccaactgtacgtccgccttcacgaatagagaaacgagttccttcttcgatagcgattgtagagataagttcaacgatcatttcagtgttatctccaggcataaccatttctacgccttctggaagattgatgataccagttacgtcagttgtacggaagtagaactgaggacggtagttagagaagaatggagtatgacgtccaccctcttctttagaaagaacgtaaacttcagctttgaatttgctgtgtggagtgattgtacctggtttagcaagtacttgaccacgttggatgtcttcacgagctacaccgcgaagaagtgcaccgatgttgtctccagcttcagcatagtcaagaagcttacggaacatttcaacacctgtaacagttgttttgctgttttcttcttgaagaccgatgatttcaacttcgtcaccgactttaacttgtccgcgttctacacggccagtagcaactgtaccacgaccagtgattgagaatacgtcctcaactggcatcatgaatggtttttcagtgtcgcgttctggagttgggatgtactcgtcaactgcagccataagttcaagaattttttcttcgtactcagcgtcgccttcaagagctttaagagcagaacccttaacaactggtacatcatcaccagggaagtcgtattcgctaagaagatcgcgaacttccatttcaacaagctcaagaagctcttcgtcgtctaccatgtcgcatttgttaaggaatactacgatgtatggtacaccaacgtttttagaaagaaggatgtgctcacgagtttgtggcattgggccatcagcagcagatactacaaggatagctccgtccatttgcgcagcaccagtgatcatgtttttaacatagtcagcgtgtcctgggcagtcaacgtgtgcatagtgacgagtgtcagtttcgtactcaacgtgtgcagtagagattgtgataccgcgctcacgttcttctggagcaccatcaatttgatcgtacgccatagctgtacctttaccagatttcttatgaagtactgttgagatagcagcagttaatgttgttttaccatggtcaacgtgtccaattgtaccgatattggcatgtgatttggaacggtcgaatttttctttagccattctaaaatcctccttaagagcttttaattagtaatgtatagagtgatagaaagtgaaagcaagctctcacttcctcatcttacaatagtagttatacttgagttaagtggcaaaatcaattattcgcctttattttttttgataatttcttcagcgatgctcttcggcacttcttcgtagtgatccatgaacattgtgaacgtaccgcgtccttgcgtgttagaacgaagggcagtagcgtaaccgaacatttcagcaagaggtaccatcgcacgcacaacttgagcgttaccgcgagcttccataccttctacgcgtccgcgacgagaagtaacatcacccatgatgtctcccatgtattcttcaggaataacaacttcaactttcatgattggttcaagaagaactgggttacatttgctgactgcatttttcaatgccatagaagcagcgactttaaacgccatttcgtttgagtcaacatcatggtaagatccatcaaaaagtttcgccttgatgtcgattagcgggaatccggctaggacaccattttcaagagagtcttcaagacctgcttgtacggctgggatgtattcacgaggaacaacaccaccgacgattgcgttttcgaattcaaagccagcgccttcttcgttcggttcaaattcgatccaaacgtgaccgaactgaccgcgtccgcctgattgacgtacgaatttaccttcaacttttgcaccggtacggaatgtctcacggtacgcaacttgaggagcaccaacgttagcttcaactttgaactcacgcttcatacgatcaacaatgatatcaaggtgaagctcacccataccagagatgattgtttgacccgtttcagggtttgtttgtgtacggaatgtaggatcttcttcagcaagtttcgctaaagcgatacccattttatcttggtcagcttttgatttaggctcaatcgctacgtcgataacaggctctgggaattccattgattcaaggattacaagatccttctcatcacatagagtatctccagtagaagtatcttttagacctacagcagctgcgatgtctccagcgtaaacagtagagatctcttcacggctgttagcgtgcatttgaaggatacgtcctacgcgctcacgcttgccttttgtagagttctttacatatgaaccggaatcaagtgtaccggaatatacgcggaagaatgtcagcttaccgacataagggtcagtcataactttaaatgcaagtgcagagaatggctcttcatcagaagaatgacgaacgatctcttcatctgtgtcaggacgtacacctttgattgcagcaacatcagttggcgcaggaaggtagtcaagaacagcatcaagtacaagctgaacacctttgtttttgaaagcagatccaacaagtacagggtagaattcaacattcagtgtacctttacggatagcagctttcagttcaggaatagtgatttcttcaccctcaaggtacttttccataagctcttcatcaagctcagctacagcttcaatcaggctgctgcgaagctcttcagcttgctctttgtactcttcagggatttcttttgcatctgaacgagttccaaggtcatcttcatagaaatacgcaacgttttctactaagtcgatgataccttcgaagttgtcttcagcaccgatcggcaattgaattgcgtgagcgttagcttgaagacggtctctcagagtgcctacagagtaaaggaagtctgcgccgattttgtccattttgttgacaaatacgacacgcggtactccgtaagttgttgcttgacgccatactgtttctgtttgaggctcaacacctgattgagcatcaagtacggcaaccgcaccatcaagtacacgaagtgaacgttcaacttcaactgtgaagtctacgtgtcccggtgtatcgatgatgtttacacggtaacctttccactgtgcagttgttgctgcagaagtgattgtgattccgcgttcttgctcctgctccatccagtccatttgcgaagcaccttcgtgagtttcgccaattttgtggatacggcctgtgtagaacaagatccgttctgtagtagtcgttttaccggcatcgatgtgagccatgatcccgatattacgagttttttctaaggagaactctcttgccattgggtaatttctccttccttattagggaattgtagttttgattatataaatcctaccagcggtagtgagcgaatgctttgttcgcttctgccatcttgtgagtgtcttcacgtttcttaacggcagcaccagtgttgttagctgcatcaagaatttcgttagccaggcgctcttccattgttttttctccgcgaagacgcgcatagttaaccaaccagcgaagaccaagagttgtacggcgttcaggacgaacttctacaggcacttggtagttagctccacctacacggcgtgcttttacttcaagtacaggcatgatgtttttcaatgcttgttcgaaaacctccattgcatcattgccagtgcgttctttaatgatatcgaatgacttgtataggattgtttgagatttaccttttttaccgtcgatcatcattttgttgatcaggcgggatacaagcttagagttgtaaagcggatcaggtaaaacgtctctttttgctacaggacctttacgtggcatctgaatatcctcccttcatagttttaatgatttatttgattactttgctttagggcgtttagtaccgtatttagaacggccttgcgcacggttttcaactccggcagtatcaagcgcaccacgaacgatgtggtagcgtacccccggtaagtcttttacacgtccgccgcggatcagtacaacgctgtgctcttgcaggttgtgaccgataccaggaatgtaggcagtaacctcgattccgttagtcaaacgaacacgagcatatttacgaagtgctgagttcggttttttcggtgtcattgtacccacacgagtacataccccgcgtttttgtggagaagatacgttagtgtgctcttttttaaagctgttgtatcctttgtttagtgcaggtgacttagagttttcaactttgctcacgcgtcccttgcgaattagctgattaattgtaggcatgttgtgttcctcccttcattacgttttataacccacatacccaggtggttcatcattaggcaaaaaacaatgtctttacacaagattgaaatcttatataaaaacaaaaagtacgctataacataatggcaacagctgctgctcccacttcaattccgcaggctttgccgagctttttcatggaatccaccatacagacagcgatgttttggttctttgcaagctggataacgccagccgtaagaactgaatccgcgtcttttgccacgacgacttccttcactgaacctcgtttcagagctttcactgtttgcttcgtaccaataataattgatttggcctgtgatactttatcataagacataaacatatcctccaaagtaacaggttttatttcgagcaccttggttatattatcactctgcgggacggatgtcaacatcgtatgacattttttagtgcagtccgccgcaagaataaatgtaatactgaggaaaggctgtcgaaacagccttcccgcagcagtttatgttattcagccggaaccatatcttccgcaggctgaacgtttgaaacaggttttacttttctgtaattcatcataccggtaccggccggaaccagtttaccgatgataacattctctttcaggccgagaagttcatcacgcttgcctttaatcgcagcatctgtaagaacgcgtgttgtttcttggaatgatgcggcagacaagaatgaatctgtctcaagtgaagctttcgtgataccgagaaggacaggacggcctgtagcaggtcgattgccttcaagcagcacttttttgttcgcttctgtgaattggtgaatatcaagcaatgtgccaggaagaacatcagtatctccggcatcgatcacacggactttgcgaagcatctggcgaaccattacttctacgtgtttatcgccgatttcaaccccctgcatacggtaaaccttctgaacctcatgcagaagatattcctgaaccgttgtcaggtcagtgactttaagaagttctttcggatcgatagaaccttctgtcaggacttggccgcgggtaatctgatcaccctcagccactttcaggcgtgagttgtaaggtgccgtgtatgaacgtgtctcaacagcgccctgaacaacaatttcctgctgtttgtcgcggacttcattgatttcggcaattgtaccgtcaatttcagaaatcgtcgcttgacctttcggattacgcgcttcgaaaagctcttggatacgcggaagaccttgtgtgatatcgtctccggcaaccccgcctgtgtggaacgtacgcattgttaactgtgttccaggctcaccgatagattgggcggcgataatgcctactgcttcgccgacttcaacgtcggttccggttgcaaggtttcgtccgtagcatcgtttacatacaccatgaggagtgttacatgtaaacgcagaacggatccacacttcttcgattcctgcttcaacgatttccagcgctttatcttcatcgatcaattcgttttcgttaatgagcacagcacccgtttcaggatgtttgatctgttttctggcgaaacgtccgatcagacgctcttccagacgctcgatgatttccgtaccttctttaagcggttttgcaagaataccgcggtcagttccgcaatctgtttcacgaatgataacatcctgcgcaacatcaacaagacggcgtgtcaggtaacctgagtcagctgttttcagggcggtatcggcaagacctttacgcgcaccgtgagtggagataaagtactccaatactgtcagaccttcacggaaacttgatttgatcggcaattcaatgattcgtccagccgggttggccatcagaccccgcatacccgcaagctgcgtaaagttagatgcgttaccacgggctcctgaatcactcatcatgtaaatcgggttgacttcgtctaatgatttcatcagtttgccttggataacgtccttcgctgaactccaaattgaaataactctttcataacgttcttcttcagtgattaaaccgcgtctgaactgtttcatgacattatcaactttgctctgtgcttcttcaagaatttcctgcttatcatcgagaacgacgatatcagaaacccctactgtgatgccggctttcgttgaatatctgaaaccgaggtttttcatgcggtcaagcattttagacgtttccgtgatatggaatcgtttaaagatttccgcgatgattttacccagaataccttttttaaacggtgcgttgatcggctgctctgcaatcacagcttttacgtcagcacctttatctaagaagaaacggtcaggtgttttctcttcaatgttgctcttcgacggctcattcatgtaagggaatgactcaggaagaatttcattgaagaccagcttaccgactgttgtaattaacagttttgaacgttgctcatccgtaaatgtcacattcttcagggagttcgccgcaacggctactctcgtatgaaggtgaacatatccgttttgataagcaagaagcgcttcgtccgtatttttgaagaccatgccttcgccgactgctccggcgcgctcaagcgtcaggtagtagtttcctaataccatatcctgagacggcgtaacaaccggtttaccatctttagggttcaagatgttttgagccgcaagcatcagaatgcgcgcctcagcttgagcctcagctgataaaggtacgtgaaccgccatttggtcaccgtcaaagtcagcgttataagctgtacatactaacgggtgaagacggatggcgcgtccttcaacaagcgtaggttcgaaagcctggatacctaatctgtgaagcgtaggggcacggttcagtaagaccggatgctccttaatgacagattcaagtacatcccatacttcaggctgcacgcgttcgattttgcgttttgcgctcttgatattgtgagcaagacctttttcaacaagctctttcataacgaatggcttgaagagctcaagcgccatttccttcggcaatccgcactgatacattttcaggtgcggacctacgacgataacggaacgtcctgagtagtctacacgtttaccgagaaggttctgacggaaacgcccttgtttccctttcagcatatgagaaagagatttgagcggacggttacccggtccggtaaccggacggccgcggcgtccgttgtcaatcagagcatcgactgcttcctgaagcatacgtttttcgttctgaacgatgatgctaggagcaccgaggtctaacagacgttttaaacggttgttacggttgatgacacgacggtaaaggtcgttcaggtcagacgttgcgaaacgtccgccgtcaagctgaaccatcggtcttaactcaggcggaataaccggaagcacatcgaggatcatccaagacggcttgtttcctgaattacggaaggcttcaagcacttcaaggcgtttgatcgcacgcgtacggcgctgtccttgagaggttttcagctcttcttttaacatatcaacttctttgacgaggtcgatgtcctgcagaagtttattaatggcttccgcacccatagaggcttggaatttgtttccgtacttatccagatacgcacggtattccttttcagataaaagctgtttcttttcgagcggtgtattggccgggtcagttacgacgtaagaagcaaagtaaatgacttcttccagcgcacgcggtgacatatccaatacaagacccatacggctcggaatacctttgaaataccaaatgtgagaaaccggggcagccagttcaatatgccccattctctcacgacggactttagcccgcgttacttcaactccgcaacggtcacaaactacgcctttataacgaacccgcttgtacttgccgcaatgacattcccagtccttagtcggtccgaaaatgcgttcgcagaacaggccgtccttttcaggtttcaacgtacgatagtttatcgtttcaggctttttcacttcaccaaaagaccatgaacggattttatccggtgaagcaagaccgatgttcatatactcaaaattgttcacatctagcaaggggcctacctccctttttatcttcggattaaccgatgtcacttgcctttatcaatcagagactattctttagttactgcgtcacgttcaacgtctggagatgctgtttcttccggcgcttcatcacctgataatgcaaggccgtcagcttgtttcgcatcttcttcgtcttctagatctctcatttctatttcttcttcatcacttgagaggatttttacatccatacctaagctttgaagctctttgatcaatactttgaatgattccggaacaccaggctctggaacattatcgcctttgacgatggcttcatatgttttcacacgtccgaccacgtcatcagacttcacagtcaggatttcttgaagcgtgtaagctgcgccgtaagcttcaagcgcccaaacctccatctcaccgaaacgctgtccgccgaattgggctttaccgccgagaggctgctgcgtaacaagtgagtaagggcctgtagaacgggcatgaagtttatcatcaaccatgtgtgccagtttgatcatgtacatgattccgacagatacacggttgtcgaacggttctcccgtacggccgtcataaagaactgttttggcgtctcttgacatgcctgcttcttcaagtgtttcccacacgtcttcttcacgcgcgccgtcaaatacaggtgacgcgatgtgaatgccgaggtagcgggcagccatacccatgtgaagttctaatacctgaccgatattcatacgggatggtacacccagcgggttaagcatgatatcgatcggcgtgccgtcaggaaggtaaggcatatcttcttcaggaagaatcttcgagataacccctttgtttccgtgacgtccggccattttatccccttcagaaatcttacgtttctgaacgatatatacgcgtacaagctggttcacgcccggaggaagttcgtctccgtcttcacggttgaagacttttacgtcgtggataattccgccgccgccatgaggcacacggagagaagtatcacggacttcacgcgctttttctccaaagattgcatgcagaaggcgctcttcagccgtaagctcagttacacctttaggcgttactttacctacgagaaggtctccgtcgttgacttccgcaccgatacggataattccgcggtcatcaaggttgcgaagcgcatcttcccctacgtttggaatatcgcgggtgatctcttccggtccaagctttgtatcacgtgcttctgattcatattcttcaatgtgaatagatgtgtatacatcatctttcacaagacgttcactcatgatgatggcatcctcatagttataaccatcccatgtcatgaagccgaccattacgttgcggccgagagcaagctcacccagctccattgaagggccgtcagcaaggatttctcctttgactacttcatcaccgacactgacgatcggacgctggttgtagcacgtaccttggttggagcggacaaatttcagcaagctgtacttatccaggttgccttttactttttgaccgtcaatttcttcatagcggcgcacccatacgtttttcgcttccacccgttcaacgataccagggtgtttacaaataacggctgcaccggagtctttaccggatacgtattccatacccgttccgacgatcggagcttccggctgcatcaaaggcacagcctgacgctgcatgttcgctcccatgagggcgcggttcgagtcatcgttttccaagaacggaatacatgctgtcgcagcagatacaacctgtttaggagatacgtccatgtaatccacgcggttgcgggctacaacggtgttttcccctctgaaacgggctacgatgctgtcatccaagaaagaaccgtcatcgctcagcttagcgttcgcttgggctacgacatagttatcctcttcatcagcagtcaggtagtcgattctaggcgttacttttcctgtttcaggatcaacgcggcggtatggcgtctcaatgaaaccaaagcggtttactttcgcaaatgatgacaatgagttgatcaaaccgatgttcgggccctcaggcgtttcaatcggacacatacgtccatagtgagagtagtgaacgtcacgtacttccatacctgcacgctcacgcgtcaaaccgcccggtccgagagctgacagacggcgtttatgcgtcaattcagcaagcgggttcgtctgatccatgaattgagaaagctgtgagcttccgaagaactctttaatagacgcaataacaggtctgatgttaatcagctgctgcggcgtgattgtgtttgtgtcttgaattgacattctttcacgtacgacacgttccatccggcttaaaccgatacggaattggttttgcaggagttcacctacagaacgcagacggcggtttccgagatggtcgatatcatcagtgtcgcccactccgtgcaggaggttgaagaagtagctgatagaagaaataatatcagcaggcgtaatgtttttaatcgcctcttcaatgtaagcattgccgatcacgttgatcgtctgctctccttctgcatcagtaggagcatagattttaatggattgaagcatcacttcatcctcgactacgccgccgttaggataaagttttctgaagccgattccattttctaagtatggcagtactttatcaagtgttcttctgtcaagaatctgccctttttcagcgagaatttcaccggtttcaggatccaccagtgtctctgcaaggcgctggttaaacaggcggttcttgatatgaagctttttattaattttatagcgtcctacattcgcaaggtcgtatcgcttcggatcgaagaaacgggaatccagcaagctctttgcgttttctactgtaggcggctctccgggacgaaggcgctcatagatttcaagaagcgctttgtcactgttttcagtgttgtccttatccagtgtattgcggagatattcgttctctccaatgagatcgagaatctcttggtcggaaccgaagccgagagcacgcaaaagaaccgtaaccggcaacttacgtgtgcgatcaatgcggacatacacaacatctttcgcatcagtttcgtattctaaccatgcgccacggtttggaatgacagtcgcggtaaaaccttttttaccgtttttgtctactttaccactgaaatatacacttggagaccgaacaagctgagatacgataacacgttctgcaccgttgatgataaaagtaccggtatctgtcataatagggaaatcacccatgaagacatcctggtcttttacctctccagtttctttgttaattaaacgaaccttcactcttagcggagctgagtaagtcacatcacgttcttttgactcttcaacgggatacttaggatctcctaaactgtagtcaatgaactcaagagagaggttaccagtgaaatcctcaattggtgatatgtcttgaaacatctctctaagaccctcatcaagaaaccactgataagaagaggtttgaatttcaatgagatttggtaattctaacacttcgctaatgcgagcatagcttctgcgctggcggtgtcgtccatactgaactagttgacctgtcaactgattcacccctcaaatcatgcgtattatatgtgtaataagcatcccttacaatgaagaaatacttttacaagacaaaagaaaaaagggtttctaattaagaaaaccacatccaaaaacaaataccgattttattagcatttccatgtttgtataatttatacatgcactatgattattcagcatatcatgcaaaatatatacattggcattttacaatattaacatagctgaaaattcaagtcaaactttttttgcttttatgatataatagcctttctttttttgaacaacagaaacttcgtcaaaaagttccttcagtttttcaacggcagaaggcccgccctgttttttctgtataacgatccacaattcacctgaagcccttaaatgctcagcgcttttttcaaaaatggcatggacaactttttttccggcgcggattggggggtttgtaataatcgaagcaaatgtttgagcagaatcaatatttgaaaataaatcactctgataaatctgaacgttttttattccgtttttttctgcattttcatttgacagctctacggctctttcattcacgtcaatcatgtgcacggtccggtctgtaaattcaccggcaagcgacagaccgatcggcccgtagccgcagcctgcatccaagaagtcaccgtcaatttcaggctcttcaaacgcttcaattaagacacgtgaaccgaaatcaacttcctttttcgagaaaacgccgctgtcacttgtgaatgtataagatctgttccgcagtgtaaatgaccatgtctgtttatcgcttttaactgaaggtttttctgaataatagtgttcactcattattagaacctccttttttaatggcacttaaagaaaagcaaagaaaaagcccgcctcataaaagcgagcttcccctacaggcaagtgaagattacttaacttctacagaagcgccaacttcttcaagtttagctttaagctcttcagcttcttctttcgcaataccttctttaagtggttttggagtgttgtcaacaagttctttagcttctttcaagccaagaccagtgatttcacgaacaactttgataactttgattttctgagaacctgcaccagcaaggataaggtcgaattcgctttgctcttcagcagcgccgccagcagcagctccgccagctacagctacaggagcagcagcagttacgccaaattcttcttcgattgcttttactaggtcgttcaattcaagtacagttgcttctttaacggaagcaatgatttcttcgatatttaaagccatttgaaattcctccatttgttttattttaggttaaaatcagattaagcgccttgttcttccttttgatctgcaactgctttagctgcaagtgcaaggttgcgaactggagcttgaagtacgctaagcaacatagaaagtaagccatcgcgtgaaggaagttcagcaagagctttcacttcttcaacagaagatactttaccttcgataacgcccgctttgatttccagagcttcgtggtttttcgcgaactcgttaagaactttcgccggagcgacaacatcttcagtactgaatgcgatcgcattcggtccagttaagacatcattcaaaccatcaagttcagcttgttcaaccgcacggcgagtcattgtgtttttgtacactttgaactctacgttagcttcgcgaagctgtttacggagttcagttacttcagaaacgttaagtccgcggtagtcaacgatgatcgttgatttgctttctttcagtttagaagcaatctcttcaacaacaactttttttgtttcaattgcgctgctcatggttacacctcctgtagattttgtgtaacacttataccgctaggtgatcacgactgtgacgacgattccatataaaaagcctccatgtggacatggaggctgtatatacaagcatacgtaacgtaatagctgtgatatatatacacctcggcaggatattaagccacaacggcccctgctgtctacggtataaatgacatattatattttacaacattttgaatcatatcagaatgctgatctaaagtcaaatattattttacgttgaaagtagaagcgtctactttgacaccagggcccatagtagaagtaacggcaacgtttttcacgtaaacacctttagccgcagccggttttgctttcaggattgtatcatacattgttgtgaagttctcaacaagtttttcatcctcgaaagaaacttttccgattggaacatggatgttaccagctttatcaacgcggtattcaactttaccagctttgatttcgccgattgctttttctacttcgaatgtaacagttcctgttttagggtttggcataagaccttttggtccaagcacacggccgattttaccgacttcacccatcatgtcaggagtcgcaacgattacatcaaaatcgaaccagccttgctggattttcgtgatgtaatcagaatcgcctacgtagtctgcaccggcagcttcagcttcttttgctttttcgcctttagcgaatacaagcacacgctgagttttaccagttccgttaggaagaacgactgcaccgcggatttgctgatcgtttttacgagggtcaacccctaaacgaaaagcaacttcaactgtagcgtcgaatttagctgtgtttgtttttttagtaagcgccactgcttcagcgacgtcgtaagcttttgcacggtctacaagcttcgcagcttcaacgtactttttaccttttttagccattttaaaatttcctccttatgtggttatagcggaataacctcccacgaataagggttgcgaacttgtgaaaactcgcaacccgacaagaaacaaattaatcctcgataacgatacccatactgcgggcagtaccttcaaccatgcgcattgccgcttcaacgtctgctgcgtttaagtcaggcattttcgtttcagcgatttcgcgaaccttatcgcgcttaacggttgccactttattacggtttggttcaccagaaccagactcaattccagctgcttttttaagcaatactgcagcaggcggagtttttgtaataaatgtaaatgaacggtcttcgtaaaccgaaatttcaacaggaatgattaaaccagcttggtcagctgtacgagcgttaaactccttacagaatcccatgatatttacaccggcttgacctagtgcaggtccaactggcggcgctgggttagcttttccagcaggaatttgcaattttacaacttttactacttttttagccacgagacacacctccttaagtccgtgatgtggtaatagggtaaaccctcccactcaaggtttcattctttatatgaatgacgaaatatcaagctagctgccttggattagtccaagacgtacctttgctatattatcattaatatatagcaatttcaagttttttcacattacaatttgtcgatctgggtaaattccagttcaacaggcgtttcacggccgaacatgttaacgaatactttcactttgctcttatcataatcaatctcttcaattgatcctgtaaagttggtgaatggtccgtctatgactttgactgtctcattcaattcaaaatcaatgtctgttttccgctcgtccatgcccatccgttttaagatggcttccgcttcgccgggtaaaagcggagtcggttttgagcctgaaccggctgatccgacgaatccggtaacgcccggcgtgttgcggaccacataccatgaatcatcagtcatgacgatttcaacaagcacatatcccgggaatactttctttttgactacttttttcttgccgttcttaatatcagtctcttcttcttcaggaacgaccacgcggaaaattttatcctgcattcccattgattccacacgtttttcaaggtttgcttttactttgttttcataaccggaatacgtatgaacaacataccaattcttttccattctatcaggactctgcagtccttccctccccgcatttaaaaatgaagtgtaaaacaaaaaataggcgcagagcctatgaatccttttttcaacacaataaaaaacccgctgaacgggttttggcaaacgatattatgatctattatagcacgtattgctgatcattattcaactattaaacgaattaattgagaaattcctgtatcaaggagggcaaaaaagataacaaaaaagataaccgttgaaatcaccgtgatcgtatagcgcgttaactctttgccttttggccagctaacctttttcatttctttcccaacatctttaaagaaactcatcatgcgcatgtaaaagacctccacaatttaaaaagcgaacactattttgtttctaaatgagctgtatgtgaattgcaagtgctgcagtacttcttaacttctaaccgctcagccgctgatgcagagcttttcattgtcgtataattacgatttccgcatgttttgcatgccagcgtaatcttttttctcatatcgttacaccttttcctaaatagacattcatttatcttaataaaatagcacagtcagaaaaattctgtcaatatgacacagaaacccgctacatgctgatttctcttatttctaaatacttctcaagcttgcgctttacacgctgcaaggcattatcgattgattttacgtgtcggtttaagtcatctgaaatttcttggtaacttcttccgtctaagtacaaaacaagcacctttctctccagatcgctcagcagttctcccattttcatttcaatatcatcaaattcttcctgattaataatcatttcttcaggatttaacgttttagcgcctgagatgacatcaagcagtgttctgtctgattcttcatcaaaaataggcttgtctaaagaaacataggaatttaaaggaatgtgtttctgacgggtagctgtctttatagcggtaataatctggcgggtaatgcataattctgcaaaagctttaaatgaagtgagcttgtcctctctaaagtctcggatagacttatataagcctatcatcccttcctgtacaatatcttctctgtcagcccctattaaaaaataagacctggctttcgcccgtacaaaattacggtacttcgtaatcaagtaatctaacgcatcactatccccaacatgaaccttttcaatgacctgctcgtcctccaactggcaaaactgcactttgttgaattttcccttgttgttctgtagattcactgcgatccccccggcgcacgtagatagaaatattatacattaatgggcgaaaaagcgtcaacctaatccaggccgccgcgacgccacttttcaaacgttttcaaaacctcttcggacagctcgattttacccgggggtttttcggaagtgatctttgaaacccgtctttgaatccggcgttctatcgcatcaacttccctcagcagctcccgggcggatttgcggagagccccttgtccgaaaatcgcccactgctccgtataatcagaggtcgcgacatgaatctgtgtcgcgatattattcagcgcctgggcaagcttctcgatccgctcatccgccgtttcattctcccgtgtaaaaatcacttcgactctgtgattcgtgtgttttttctctatgccttttaccagatgtgcgtcaaacaccacaatgactttgattcccgtgtatgactgatattccgccatcttctgaatcagcacatctctcgcttcttcaaaactgttcgcttttaaatcctttagctgcggccaagctcctatcatgttgtatccgtctactaataggatgtccatcggtctttattcccctaaaggattgcgtttccggtagacttcatacatcagaaggccggccgctactgacgcattcagagacgtgacttttccggccatcggaagtttaatgagaaaatcacatttctctttcacaaggcggcccattcctcttccttcgcttccgataacaagcgccaaaggcatcttgccgtccatagagcggtagtcttcccgggcggatgcatccgttccgacaacccaaatgccccgctccttcatttcatcaagtgtccgggcaaggttggtcaccttcacgacgggaatgtgttcaatggcaccggtcgatgcttttgcgaccgtcgcagtcagaccgaccgctctgcgtttcggaataacgatgccgtgtgcgccgacggcatcagccgttctcatgatagatccgaggttatgagggtcttccagctcgtccaatatgagaaagaaaggctgttcgtttctctcttccgctcttttatataattcgtctaattgtgcatattcatatgccgccacctgggcgacaactccctgatgctgcccctccaccatctgatcgagttttttcctcggtacaaattggatagtgatgccttgttttttcgcaagctcaataacttgctgcgcctgtccttttactgtgttttccgccatccataacttgtacagcttgcgatcagactttaacgtctcaatcactgcgttttttcctatgacgtaatcatgttgctgactcatttgttttcctccctgacgtcccgacttgtaaagcctcagtaatcagctgatccagtctttcttctcttttctcaagaaaaagatatccgagcaaagcctcaaaagctgtactatggcggtacgtctgtacatctgtgtttttaggtgtcgtccctgatttcgcgtttcttcctcttctcagcacggcttcctcttcttccgtgaaaaaggattcgtcctgaaggcggaaaagaatgtctgcctgtgattttgccgatacaatccggcttgctttcttatgaaggtcattcggtttcgtatggccctgcttaagcaggtgatgccggacatatatttcaaaaatggcatcacccatataagcgagcgcaagaccgtttaactgctttgaatctttgatttgttcaaattgaagcatccgcttactctccccgcttccagcgagttccctgagccgtatcctcaagaatgatattcatgcttttcagctgatcgcgaatctggtcggataaagcaaaatcgcgattacggcgggcttcatttctcttctcaatcaattcttcaatttcttcatcgacaagctcttcttcaccgagcgtaagtccgagaacagatccgattctgtcaaacatgctgataaaggctttaatgacgtgatccgccgtattgtcctcctgcatgtagtaattggcgagcttcgctaaatcaaaccatacggaaatcgcattcgccgtattaaagtcatcatccattgcttcttcaaatgccgtgcggtgctcttcgattttagcgagccattcatcatcattgtcagtcagattcgtgctgctaatcaaacgatggtttaaattactgtaggccgtcttcaagcggttaaacgcgttttttgttttctcaagcagctcctccgaatagttgatcgggtggcggtaatgaacggacagcatgaaaaatctcagcagctgcgggtcatattgcttaatgatatcgtgcaccaaaacaaagttgccgagcgattttgacattttctcattatctatattgatataaccgttgtgaagccagtattttgcgaatgtcttgcctgtcaatgcttcggattgtgcgatttcattttcatggtgcgggaatgtcaggtcctgaccgccggcatgaatatcgatctcgtcacccaaatactttttcaccattgcggagcattcaatatgccagcctgggcggccttttccccaagggctatcccatgagatttctccgtctttggcggctttccaaagagcaaagtccagcgcatcctctttcttctcaccgacacggatacgcgctccagatctgagttcatcaattgattgctgagatagcttgccgtagccttcgaaggctcttgttttgaaatagacgtcgccttctgattcataagcgtagccttttttaatcagctcgctgacaaattcaataatggcgtccatgttctccataacccgagggtgaagatctgctttccggcatccgagggcgcccacgtcttcaaaatacgctttaatgaaccgctcagaaacggtcggaacgtcctcgccgagctcgttggcggctttaatcagtttgtcgtcaacatcggtgaaattcgatacatattgaacgtcgtaccctttatattccaaatagttgcgtacggtgtcatacacaatcgccggacgggcgtttccgatatgaatatagttgtatacagtcggtccgcacacgtacatttttacttttccttcctcaagaggaacgaatgtttcctttttccgtgtcaatgtattataaagtgtaatggtcatttttggttgatcctttcttttttatcttccagttcagcctgcagctcaaaaatctgctgctccaatgctctaaaccggtcagcaaccggatcgggcaagtcttggtgattgagatcgcgtttgatttttcttccgttctgaatgacgacttttcccggtatgccgacaacggttgaaaagtcgggaacatcacgcagcacaacggagccggcccctactttagaaccttgcccgactgttatagagccgagcaccttcgcccctgttgcaattaaagcatcatctttaatggtcggatgccgctttcccttttcttttcccgttcccccgagagtgacaccttggaaaaccgtcacgttattgccgatttcacacgtttcccctatgacgacccccataccgtggtcaatgaaaaatcttctcccgatggtcgcgccgggatggatttcaataccggtaaagaaacgggcaatctgcgatatcagccgcgcaaggaagaaaaacctccgtttatataaagcatgtgcaatccgatgcgcccatatagcatgtaaaccagaataagttaaaacaacttcgaaatagcttcttgctgccggatcttgatcgaacactgtatctatgtcttcttttagcattttaaaaaacacatgcttccccccattctctccccgctccagtctatttttccgcctataaaaaaagcgcctctgcatgtaaacatgacagagacgcttttaccgcgcggttccactctgtttgaaaaacaaaatgctgttttcccaacttaaaagccggtaacggcggcggccgcctttaaatactgatttccgcagaaatgttcttcaaaggtcttaagggcgcacttctaaaacatgacgcatgaatctctctcagccgatgaagattctttctgtaatggtcattgttttatactcttccctgtcaacaatcgtatatttagatgcttttcaggcgttttacggctgtttctcttccgatcagctcaatagcctgcggaagctccggaccgtgtgtctggccggtaaccgctacacgaatcggcatgaacagctttttgcctttatggcctgtttctttctgaacagctttaattgaggctttgatctgctcaggcgtaaattcttcaagctcttcaagcttcgcagcaaatgcgctgagcacttcaggcacctgttcttcttccagaacggcttttgcctcttgattatactcgatttcatccttaaagaacaaatcagtcagctcgacaatttcagcgccgtagctcaattgctcatgataaagagagatcaacttatgcacccattcctgctcttcggcagaaagctcagtgccgacttttcctgctttttgcaggtgaggaagagtcagctcaacaacttgatcaagatccagcgctttgacgtattggttgttgacccatttcagtttatgcatatcaaacagagccggtgacttagataaacgattcacatcaaaaatttcaataaattgctctcttgtgaagagctcttcttcaccgacaggagaccagccgagaagtccgataaagttaaacagcgcttcaggcaggtaacccagctcttcatactgctcaataaactggataattgattcatcacgcttacttaattttttgcggctttcgtttacgataagcgtcatatgaccgaatacaggaatatcccagccgaacgcctgaaaaatcatgatctgtttcggtgtatttgaaatatggtcttcaccgcggagcacgtgcgtcattttcattaagtaatcgtcaattgcgacggcaaagttatacgtcggtgttccgtcttttttgacgatgacaaagtcgccgataccgtctgattcaaaagaaatctcgccctttacgatatcgttaaaagcgatgattttcccttccggcacgcggaaacggatgctcggctgtctgccttcggctaaaaactgctcctgctcttcctgagtcaggtttctgtgtttgccggaatagcgcggcatttccccgcgggcgatctgctcttcacgttctttttcaagttcttcttccgtacagaaacatttataagcaagccctttttcaagaagctcttcatagtatactttgtaaatgtcgttacgctcagactggcggtacgggccgtactctccgccgacatccacactttcatcccagtccatgccgagccatttcaaatagttaagctggctttgctctccgccttcaatatttcgctttttgtccgtgtcctcaatccggataataaactttccgccttggctgcgggcaaataaatagttaaaaagcgccgttctggcgttaccgatatgcaaatgtccggtcggactcggtgcatagcgaacgcgtacttcatttcccatgttcaaatacttcctttcatctcgtctgtagcctctagccgaatatatgtatctattctaccaccaaatagaccgggcatcaaaacaatgatcaggctttttggatcagaacggtcgcctgagcggcaattccttcggctcttccggtaaacccgagcttttctgtcgttgtcgcttttacatttacttgagagacgtctgcctcaagaccttccgctattcgttttctcatagcatcaatatgcggagccattttcggcttttgcgcaataatcgtgcagtctatatttccgagtacatatcctttttctttgacaatattccagacatgctgaagcagcttaaaagaatccgcatccttgaattccggatcagtatccgggaaatgcctgccgatatctccttcacctaccgctccaaggcacgcgtctgcgactgtatgaagcaatacatccgcatcagaatgcccgagcagccctttttcataaggtatttcaattccgccgatgatgagaggacggccttccgttaattgatgcacatcaaatccttgtccgattctaaacattatgattcccactttccgctttcatgattgcttccgctgttatcagatcatccggtgttgtcagcttaatattggtatagctgccttcaacgatactcacctgatatccgtcaagccgctcgacgagactggcgtcatccgtgcctaagaagcctttattttccgcctccatatgcgccttcttcaataaagaaagacgaaaagcctgcggcgtttgaacggcccacaagcttgaacggtcaaaggtctccgcaacccgggagccttccgcccgttttatcgtatctttcacaggaacagccaggacagccgctcccgcctcctctgctgtttcaacgagcttatcgatatgctgatgcgtgacaaacgggcgcgccccgtcatgaacaaggacgacggactccttatcaatcactttcaatccttcgtatacactgtgctgacgctccgccccgccggtgacaagctcaacttccgtttggatcggaaattgggcgagcagctgacgaaaatcttcccgttcactttcattgatcacgaggattatttttttacacgggccgtggctttcaaaaacccgcagtgtgtgtataataacaggcgcaccctttaagctgatgaacagcttatttttcccggccttcatccgtttcccttgtccggcagccggaatgactacgacatactccatcattaactccctcttaaagagccttctcaagcagcttaggcttggcaaaaatcattcgccccgctgctgtctgcagtacgctggttacaagcacatcaatatgtttccctatataattgcggccttcttccacaacgatcattgttccgtcatccaagtaagccacaccttgattatgctctttcccgtccttaatcacctgcacattcatctcttcacccggaagcacaaccggcttcacggcgttcgcaaggtcattaatattcagtaccgcaaccttctgaagctcacatactttatttaaattaaaatcattcgtcacaacgacgccggatgtcagcttcgcaagtttgacaagcttgctgtcaacctcctgaatgtcttcaaagtcgccttcataaatttcaacggtaatatcaagttccttttgaatgcgattcaagatatccagtccgcggcgtcctctgttacgttttaaaacatctgaagaatcggcgatatgctgtaattcctccagcacaaattgaggaattacaatgactccttctaaaaagcccgtctgacaaatatctgcaattctcccatcaataataacacttgtatccaagattttcagccttttctcctgttcctcctgctcctcatcgccgcttccctttttcttctgcattcttgcagaaatggagaacaggctgatcagttcatcctttttcttaaatccgacctgaaagccgagataaccgagaaagaaagccagaaagaccgggatgatggtgctgaatatacggtacggaatattgtccagcggaatcacgtttacaatgagatatgcgatgataagtccaaaaaccaatccgagacttccgaataacagatccggcaccggggctctcagcaaagaatcttcaatccattttacccaattaatcacatattctgtcgtccatatactgatgagaaaaaagataatagcaccaattgcagcagacgtatatgcgtttgttattaaaggtatgtcctgtatatttgacagtacaaacaattcaggtattaaaaagataccgacaacgcaacccacaataatgaagaacgcctgaactattcgttttaacatacccccacctccttttaagtagcatttttcagcagactgtcaaagcctacaaatatcagaataaacaaaaactaacaataatatacccggattcccacaggtttaagcgatacttaaagctgtctatctatatagtgtttttcttggaggcgttttaagccttttttgattttttgggcgcgcacctcgccgataccttcaacatcatccagttcttcggctgtcgcttccgttatgcttggcaaaaatccgaatgcctcaaccacattttcaacaatcggcatcggcagacgcggaattttgttcagcagcctgtatcctctcggcagaacataatcatcgagattggtagaagcgggatatccaagcagcttaaacaaaatggaatcatcaagcagatcatagctggacatatcctgaagctcttttaacagcacgaacggatctttgattttttcttttacatagtctttgatgaaaagagccgcttcttcttccatatccgtaatcagttcaatcacctgcagacggattaagtggccttccgttccgagttctttaatatacatgttgatttcattttttatacggagcaccatttcataccggtgcatgacggacagcacgtcactgaatgtcacaagctcctcaaattctaaggcgtttaaagctgtaatcgttttgtctagaatggttttatacttctcaagcgtttgaatggcctggttagcctttgttaaaataaagcctatgtcctttagtgtgtacttcatgctgtcctggtataacgtaatgacatttctgcgttcagaaatggctatgacgagacagccggtctgctttgccacccgttccgctgtacggtgcctcattcccgtttctgaagaagaaatggtcgcctccggcataagctgcgtattcgcataaagaattttctggccggaatcacttaaaataatggctccgtccattttggccagctcgtataagtgagcgggcgcaaatgatgtattaatatgaaaaccgccatccacgacttgttttaccttatcgttgtatccgacaacaatcaggccgcctgtatttgcccgaagtacattttctatcccggctctgagcggggttcccggtgcaacgaactgcaggattgcagacaggtcaagctcttgtttcgccccttttttctctttttccatctattatgatcctcctaatgaagtacgaagcgcttctgcaacatttgctactccgacaacctcaatcccttttggtattgtccatccgtctgaatttgcctcaggtatgaccatacgcttgaagccgagcttcgccgcttcttttacgcgctgttcgattcttgacaccctgcggacttctcctgtcagacccacttcaccgataaagcaatctgcaggatttggcggtgtatctctgaagcttgaagcaatgctgacggctactgccaaatcaatcgctggttcatccagtttgaccccgccggcgacttttaaatacgcatcttgattttgaagcaacagccccacccgcttctcaagcacagccatgattaacgacaccctgttgtggtcaattcctgtagccatgcggcgcggatttccgaagctggtcggtgatatgagcgcctggatttcaactaagatcggtctcgtgccttccattgacgcaacgatactcgaacccgaagccccggcagaacgctcttctaagaaaatttcagaagggttcagcacttctgtaagcccttcttcccgcatttcaaagatgcccatttcatttgttgagccgaaacggttttttacagcccgcaaaatacggaatgtatggtgccgctctccttcaaagtatagaacggtatcgaccatatgctcaagcaatctcggtcctgcgatcgatccttcttttgtaacgtgtccgacgataaaaataggtatgccgtttgttttcgcgattttcatcaattcggccgtacactctcttacttgtgatacactgccgggagctgaggtgatatcactttggtaaacggtctgaatggagtctaccacaacaaatgcgggtttcatctcttgtatagcagacgaaatatactccatatcggtttcagataaaacatgtaacaattggctgttgattccaagtctgtcggcgcgcagcttcgtttgcttcacagattcttccccagaaatgtaaagcacgctgccggccgtgtctgctaattgtgcggatacttgaagaaggagcgttgatttaccgatgccgggatcgccgccgattaatactaacgagcccttcacaactccgccgccaagcactctgttgaattcttcgagcttggtttgaacgcggggttcttctgatgtttcaattgatgtaatgggtgatggtttctggacggtttgaacggaatgggagaaagccgcccgccgattcgccggcgctttttttatggtttcttccaccattgtattccaagccccgcagcccgggcactttcccatccattttgcggattcataaccgcatgagtggcagatgaattttgtttttgatttagccatatacgctgtaagacctcttccttatcgaatatttctctatataacaaagtgaggcatacacttgcttacgtatgcctcatgtttgtcactatattagttcgttttagcagtcgtttttacgacaaattcgccgtcctctacatcaagaacgatgtgctgccctttatcaatattgcccctgaggagctcttctgataaacggtcctccacatgcttttggatcgctcttcttaacggacgtgcgccgtattccaaatcgacgccctcgtctgctacttttgcttttgcagcttctgtcagctctatagagagatcttgttctttcagacgttttgttaactggtcagacataagcgacacgatgtctgtaagatgttttttctcaagggagtggaagacgataatttcgtcaatccggttgataaactcaggcctgaaggcacgcttcagctctcccatcactttgtctttcatgtctttatggttttgtgattcatcctgaacattgaagccgacatatttgttgcgtttcagctcgctcgctccgacgtttgacgtcataatcaggatcgtgttgcggaaatcaacagtgcgtccttttgaatcagtcaagcgtccgtcttcaagcacttgcaagagaatgttaaacacatcaggatgcgctttttcaatttcatcaagcagtacgacagagtaaggttttcttctcactttttctgtcagctggccgccttcatcatagccgacatatcccggaggagaaccgacaaggcgtgaagtcgaatgtttctccatgtattcggacatatccactctgatcatcgcttcctcatcaccgaaaatggattccgccagtgctcttgccagctctgtcttccctacgcctgtaggacctaagaagatgaatgaaccaatcggacgtttcggatccttcagaccggctcttgcacgtctcacagcctttgcaacggctacaacggcttcatcctggccaatgacacgagagtgcagaatgctttccatattgagaagcttatctgtttccgtttgcgcaattttagatacaggcaccccggtccagctggatacaaccatcgcgatatcctctacagaaacttcggagttctcttggccttgtttttctttccacgtttttttcgtatcttccacctgttctctcaggcgctgctccgtatcacgaagagaagccgctttttcaaattcctggctttgaacggcagcgtctttttccttgcgaacttcatcaagcttctgctcaagctcttttaagttcggaggcgttgtgaaagaacggagacgcacttttgaaccggcttcgtcaattaaatcgatcgctttatccggaaggaagcggtcagatatataacggtcggacaatttaactgccgcttcgatcgcttcatcagtaatggatacgcggtgatgcgcttcatagcggtcacggagtccttttaaaatttgaatgctttcatcgactgacggctcatccacctgaatcggctggaaacggcgctccagggctgcgtctttttcgatatatttgcggtattcatcaagcgttgtcgcaccgatgcactgaagctctccgcgcgccaatgaaggttttaaaatattcgacgcgtcaatcgcaccttctgctcctcccgctccgatcagtgtgtgcagttcatcaatgaataaaatgatattgccggcctgacgtatttcatccattacctttttcaagcggtcttcaaattctccgcggtatttcgtgccggctacaaccgtccccatatctaacgtcattacgcgtttatcacgtaaaatttccggcacttcattgttgatgatctgctgtgcgaggccttcggcaatcgcagttttacctacacccggttctccaataagaacggggttattctttgttctgcggcttaatacctcaataacacgctgaatttctttgcttcggccgataaccggatcaaggctgtcttccctcgcaatcgcggttaaatcacgcgccagactgtcaagcgtcggagtgtttgcgctgctatttgttccggctccagatgtccctgtttcattgcttccgagaagctgaagaacctgctgtctcgccttattgagactgacacccagattattcagaactctcgcggcgactccctcaccttcacgaatcagcccgagaagtatgtgttctgttcctacataagaatgtcccagctttctggcttcatccattgagagttctattaccttttttgctcgaggcgtgtaatgagggacagatgtggtgctttcctgtcctcggccaatcaaactttccacttctttttgcattttatctgaattgaggcccagcgcttctaaggctttaaatgctatcccttcaccttcacggactaaccccaataatatatgttcagttccgatatttgtatggcctaagcgcagtgcttcttcctgtgccagtgccaataccttttgagctcgctctgtaaatcttccaaacatcatatcgaatcatcctcctgtctatttgcactcatttctaaatgcagcctttccctgataagagccgctcttctcacgtctctttcgttcggccgtaatgcaccgcccgaatattgctggagaaaacccggctgtgtcaaaatcatcagttcattaagtatattgcttgatagccctttaatgatccccaggtctatccccagccgaacgtcagaaaggcatttcgccgtttccttcgattcaatcatacggcagttggataaaactccgtaagatctgaatacccggtcctctaattcaattttcgaggtttgataaagcgcttctcgggctgagcgttcctgctcaatcagctgggcagccacactgttcaaatcatcgacgatgtcctgttctgactttccaagtgtgatttgatttgaaatttgaaagatatttcctaatgcttcgctgccttcaccgtaaattcctctaacaaccagacctaattggttaattgccggtataattcgattcatttgcctagttaatacgagacccggcaaatgcatcatgaccgaagcccttagccccgtccctacatttgtaggacagcttgttaagtaccctctcttctcaccaaaggcgtaatccactttctcctcaatccagtcatcaacctggtttgcagcttttatcgcattgagaagctggaagccggggaagaggcattgaattctgatatgatcttcttcatttaacataatgctgacttcctcattttcagaaagcagacagccgccaaacggcgattccgttaaattcgggctgatcagatgtttctccatcagcacccgtttttccagaggctgagcttcactcattctgattaaatgaaattgaccgatatcaggaagttttttccctgaaaaatgatcttcgaattgctgaataatggatgaggcttcttcattcgtataccgggcaggaaactttatattttcaaagttacgggccaaccgtatacggctgctgagtacaatgtcactttcaggtccctcttgcttcatccaattgcttaatgcgtcctgaataaaatgcttgagcgacattacccttgttcctcctcactgtctgtgctttttaattcctgctccaacgatcggatctgatccctgacctgcgctgctttttcaaactcttcctggtgtattaaagattctagctccttttttaacatttccatttgccgccttacatgcaggtttccgcctatacgttttggaattttcccggcgtgcaccgtattcccgctgtggactttccgcaagatcggcgtaatttggctatagaacgtatcgtaacactccgcacagccgaaccgcccagttttcctcagttgctgaaacgtcatgccgcatttcttacaagctgtgccttgctctgggtagccgaacatttgagaacccgtgttttgaaatgaagactccatattcagcagccctgataataaattatgaatcgagaacccttggtttccacttataccgtatgagtcactgttttcttttgcgcattgttcacatatatgaacttcttgcttttctccattaacaactttcgtaaagtgaaaagtggccggtctctcattgcactcttgacaaatcaatcttttcacccgcttactttagttttaaagatgtgagcattgctttcatcattctggctcttagctcatcccgttcgggcaaatcaatatatagaactgagcgatccattacactcaccatcattttagcttctctttccgaaataaccccgtcctctaacagtctgagaataatatcatcagaggctgcctgagacaagtgggtatgaatttgcgaaataatattattgataaggacgacttcgttattcattttaattttgataatacgaatataaccgccgcctccccgtttactttcaacaatatatcctctttcgcttgtgaatctggtgttgatgacataatttatttgagaaggaacacactgaaatttatcagcaatttcactgcgcttgatctctaaaatttctttgccattttgatctaatacttgttttaagtactgttcaatgatgtcagaaatattatgtcccactcaaccccctcctttattgactttgactatatttgactttaatcttactataaggtgtttcgcaaaatttttcaactgtagcgctctatctctattatttccactttacacaagcataaaacctgcttttgcaaaaaggcatatcgttacttttctcgtattatataacgtatgcagaaaaacacaaaaaaggcagctcatgatgagctgcctttaccgttaagataggcggttttaacattcgtttttgtccagctcgttacctcaaacgcaaggggtgcgttattgtatatcactgcaaaacctcctttaccgcataaaaataactgctacaccgtatcccttttcggaatcgtaagccgtcttaattcgcattactttaaatccgctgttgtcccctgttttcgttgcaacaccgtctgtgcccgccgtaaccctatcgcctactttgacagtgtcgtcaatgcgcacgtgtatttgaccgattagcccgacgatatgccactcaacgcgctcatcacgcggaatatattcgagggtcggatcatagttaggattttctttcggcacgaccagctcgcggccattctcgatgattgtttcgtagatcatgccgccaaactcgttacgcaagaaccgatcattccagtaaaaacccgcgcctcccaatacaacgcccgcagtttcggatataatgccgtccacgctgtcccctggctgcgcttttcggattttatcgccttcgagcgttaccataaggctggaatcaattctctgtccgtccagtgactcgaagtattccgcaacgtccttaaaatcggaaacactttcgacccggccgacgccctgaatattaccgttcatggagtcgatcttccatttgatgttccctgcggatgcttcgccagaaccatacccgcctacaaccgtataaccgtcatcgtttattacggactgtgacgataagatagtccgagccgggccgtcgccttttgtatgcgaattgttcgttgcgagaatagcctgccgcgatccttcagtcgatgaacctcccgaaacgccgcccatgaagtttctaggccctttcgcaacattatcacccgtagccgcaatgattgcgctcgtcggatctaggggtgatccgctcgtggtagcgcctttgaatcctcctttaaaattcgtgggcacaacgctgtacgaacgcccaccgaggtttgccgcagatgcatacccagtcgcgttaattgcagcaagttctacttggttattaggagaataaacgcccatctcaccgttatctccaatcaatgtggcgccaatcagagacgcattataaaccccgccaccgaacgcgacaccaatcggtgaagactcggagatagttacgccggagatctgtacatagtcagttctttgcgcgccgccaaaagctcgtatgtcgtggctggccgtcttaaaccctcgaatcttgattccatcaacgttgatatagctagatttaaattgaaacgctactaccgggttagccttgtaatcgtattgtggatcgccgatcgcagtaaaattcgaaatctgaacatgtttataggctgagatacccaacgctcttggagaaatatctgcgtataaactattaaagacgggttcaatcgatgtgcaatttgcgaatgtcacatgatacgcagatgtactctcaggatcagtctcgctatgatgggcgatgtgtcttgcatcgtaagaacgaacgtctctataagaaatatgattcgtcacatggatgttttgcgatgccggccattctttgtgcgcctttacttcgacgcctcgaatgtttccactcgtataacagccgtctacccaaacattttttgacccgtcatcaatttcgatcccattcgaattagcagcaccggctgggtgcgcctttccgctagggctcatacaatgcgaatttgaaatgaaaatgtattcgctataatgcgtcgtaattccgtcatcaccataaccggacgcaacgcagttatccagccaaacgtaatatgatccgtcagccgtataattttccgcagtattgtcgtatgtcggagccgttatatcgaagccgtgtagaccggggtttaccgcctctacgtccttaatccaaccgaattttactttcgcgaaagttaagcagctcgaatttataccgcccgtcgcagtcacgccgccttgtcgatccgggtaccaatcgagcgtcattccctctacgtagatattccggtttcctcctgagtggtcagcgttcgtaataacccactcactggccggcgtatcctcgtgtagcttcagcgtagtaacgccttttccttgaccgataagatacgtccatgaggggagtttagcgcctttgatgacgtattcgcccgccgataaattaaggcgcaccttaccattaccgagtgcccttacgaaagcatccgtactatctgttttgccagtaggatcggcgccataatcgtccacgtttacgttgcgttgaattttccggagcaacttgtagtactctttatcgagccgctcttttaatagaggttcaacgttgccgtccgcgtctacacgagcgtctaccacctcttttacgttcgttccgtctgcgttaagaatcaagttttttatacggttatacagaccgtctatatatgtgcgcaaagaaaaaccgctatggtcaatctgatctgacgtatgggcatgctccgcggtcttatggcggctcaaaccgttactcagatcgagcatgtcgttgccgatgtcttcgaggttttggttatagttcttgatatactgacggtcaaacccgcctgtatcagctttcttatatgagtatttccccatgcgctcacctccgtttagttcgctttaaattgcgtgttgattgcgataaaagcgttcgcagtagaattcgtactgctttcgatgcaaacatcgccatttgtttttataacgccggtataaataaaaccaacgcctgccgatccggtaaaatgatacgggtaagttggccgaaaaccttccggaagtgtgtaaaccggtgttgtcggtccgatggttccacctttcgcaacgcctcgtaatatcaccgttccgaccatatccttaccgtactgaaccggataacttccagaagcgtcagtgtattgcgcccatccgttttttaacgtcggagccgtccaggttatagtcgttagacgggcttccaatgcagcggccgctccaccggactcctttgaatcccacgataacttctctgatgcagttacgtgtatatccgtgttttttacatgcgcatctaaatcgctcttgagcgccaatcccgcggtattcagcgcgcttgctttaatggttccggtcgacgaatcgattaccttatcaaccgttttcttagtcgtatcaaaatccgcaattaaatccgacgcttttttcgtgactgacccgaatgtgaaaaccggtggctttttgtcattcgaatagtcttcgatagttaagacgcgtagctgaacgttaatatcaaacggttcgataacgcaccacagataatcgccttttctcacgtctttaaaacccatatttgcgagctcaatagccgtaaatgttagcgaaatgtccagactgtcaccgagcttattcttcatttctgccagcaacgaagatctatccgtaaacctttcgtcttttaccggctcggcgtgctttattccgtagatcgttgctagtggacttgtatactccgcctgcacaacataggtaccatcatctttttgtttaccgtagccgcgaatataagtcgcaaagctactagtatcgatctctttttccggctcactgacgttgtacttgtatcgcagaaaaggttcgtctttcttgctgccgatctttttcgcaatgtaaatacgcttaccagcgtaatcaaactctgcgccaaacttttcgagaatgcttcgcagtaaagctaacgaattatcccatccgaagttttgaacctctactgatgtcggaagatccgtatagtctacttcgtacgtgtatccggtcccttttaacgcaaaatcgagcatcgcatttattcgcatcgtgcccgatttctcttcgtaaatccgataatttatcaagtcgtcaaatatccggtgaagtgccgttacctcaacgcccacgccgtttttggacgttttttccttgtgcgttttgataatgtattcttcgtctttataaataaggatattttcatttttaacgagtttataaccgtgttgatttagagccgtcttatatcccgttacatttaacgttttttctccctcgattccgttactacgcgtagcaaagaagcccggcaaaggttccgcgattcccgatatatcttttactgctaaaatagccatcgtcgctgcacctacttatacaaataatgaaaatcgaaagatatttcgaagcttcccaccgttccggaaagttcgatctcgttccatccgggagcaagcgaaatgtagcctcggttcgtattcgcgtatatgcttgtgccgttcttcaaatgccggaggccttcgagattcagcacatcggttaatccggagctccccgaataagccaccgtttgggtagtcgttttattcgcgagcttaaaattagatgaggcgcctttataaacgatgtctaacggtacgtcttcggctggatcaattgtgacgttacctgcgttataaattcggaatctgttcgttttgtgtcgatacgataaatcgtccgaaggtaacatgccttgcgcgacttgccacttatcggagttaaacgttaatgggtcgagcgttgaacctaaagaagccgcaaaaggaaaagcagccgtaaactcaaccgtaagttttccgctccttggcgtaatatcttccggctcgtacgtgctgcttacttttacggaccaaacctttccgggctggcgcgaatctataatttccatttcgttctgtgtcgcgaatagattgtatatctcatccagtaacaaatgataatcgagatgatccacgcctttaaaaagaaagacggccgttaacttccggatgtcgaatgtcgtacctacatcgattgatccgttacggccgtctatttcctgaagatctgtacggtgggttaacgagtcctttcgaaaactaaggagccgcaaaccgaaatcacggtgatcgatcgtctcaccgttttttataattatcagatgcactaccgatcacccctaaataatcttttcatcgtagcttgttgcgcctgagagctgtcgacgtagttagtaaaagcatccttatctacccgtacgctcggatctttttgagcgattatattaagcgccgctaaagatcgttgctccacgctaaccagccgctcaagcagattcgctacaaccgtctgatctgttccgctctctacgcctaatttcttaccggtttctttataaagctgaagcgcccgctgacggttattctttaacgggatgactgcttccggaccctcttccgcaacccaggcgagttgcttttgcgttacaatgtcgccgattttgtaacccttgtaagggccgccggcacgcattgatttaattcccggaacgttgaaaaccgttttgtatcgggaaatgatgtagcgaatggccgcaaccgcgttgtgaaccggattcatgatatcgcccattcccttcattttatacgcgtcaaacgtcggtctaatcgtctgcataagacccatcgatggcgttccccgtttccagttgctatcccatttgttgatcgttgaaggaccggtccttcctccggattctttcattgcgattgttgttaatgggttaaaccaactactcggtacttttgtggctgccatcgctttacgaatccattgttttacgttgcctgtcgctttttctccgcttccgaaaccgccgccaaaatcatctatttgcttcttgacgaagccgaccattgacgacttaatcttttcataggcccctttcgccatgttgccgaatacgccggagatttccggaagcttcaggccgagactgccgacgactttcgagactaactttttcggatcggaaacgtagtcccacacgtcaaacgcgaattctttaactttgttgacggcacctttcgcgacattaacaacagcgtcttttgcacccgaaactgcatctacgcctttttcgaaaaggtttttctttttcgtaccgttattgtaggccgggatgccttgcgcaataagctttttcgtcatatcgtgtggaaggacttgcgtacctttcggaagattaaagagcgtatcactgcctgggcttaacccggtgaatccggaaggtgtacggaataactcagggccgccgccatcgcctaagatcgccgggccgcctggatgtccgcctgctgacgtacctttcgcgtatctaggaatctctaacttcggaatatagtgttttttatcaacgccgattagtccgaggaccttgttgataccgtcttgcgttaaaccattgacaattccttcgatgccgccaagaagtttattacctaaagatttaactccatccatagccttatgcgccatgtttttaattccatcgcctatcttaccgggaagttctttagcatttgtaaccatcttgtcaaaagtttcaaccgcaaaatcttttattcgtttaaagaaatttttagtatttccccacaaagagttccaagcacttaccgcaccgtcgactactttccctgccaggtttttaacagttccccatatactgttccatatactcgttagaaatccccatatcgcattaaaaacagaagaagttacagactttattaggttccacgcagttgtaacaactaataaaactaagttaacggcacctttaataactgatgtgataatcgaccaaacgctcgtcaggattcccaatacagcattccaaacaccttgccagtctccttttaataaggaggaaaaaagattgatgacattagttactatattaagcgcgccctgaatgacttttacaattaccgggaacacaatctgtacaacttgaaggataaaacgaattgctggaatgactatgttttgaataattattgctacacccttcaatatcgcaatgataactgggactgccgcttggataatcgctagaacaacagggaaaaccgcttgaaccacgttaagtacaagaggtaatacattagttacgagatctttgattacggtagcgagtaatttgattatcgcaacaacaatcggtaatgctgcttgtatgattgtcaggactgcagggaaaatcgcctgaacggcgctcaataatatcggaagtacctgagtcgcgatcaattgaattatcggcacgattgcttgaataagactcaaagctactggaaataccgcttggactacgttcagaataatcggcagtaatgacgtaaacccttcgacgagcaccggaagcaccgccgttacgattgacgtaattatttgtagcattgaactttgtacctgcgcccacacgcttactagcccgctaaccaggctgatgatccccggaagcatctgcgcaaaagcacccgccaattctccgattaaaggcgtaatctgaacgactgcatccgaaaatgcagctcctaaagaacccgctaaacttacgaacgtcgcacctaattgcgcgaaggctggtccgagctctgcaatcgctgcgcctagctccgcaaaagccggctctaacgtagcgagactcgtaaccataacgttcatcgtttccgcgaactccggcgctaattcagcagcgatttcaccgaagtattgactgaatgcgtcaaataccggttgcagagccgtcattgcgctactaattacgctcgatacttgcgcccaaacagtcgttactgaggtgcggaactgttcgttagattgataaaggcggaataaaaatccggacaaactaactagcgcggtgatcgcgaggcctatcggacctgatacgcccgctaaagctaagccgaacgccgtaatcgttggagcgacaatagagattacgccaccgacgcttgagaaagccgttttcaattgtgcgaagaataacccagccgcgtccgatactttagctgcgactccttggccgaagaattccgaggctttctgtccgagcgagtaaaagaacgcacctattgcagcgatcgcaccattgaatccgctctgaattgcggtacctatgttgaccgcgccggctgcaaatccgttccacatagccggtcctttttcgagcaagtacgctgagactcgatcgacagccgcaatgattccatcaaacgctaccttcgcgccgttgtaagcgactaaggcaccggatttgattgcgttaaacactacgcctaaaagcttctgtaactgctccgaatgtttgtatacgagcacaaaaacggtcactagtgcggttatgcctgctattgttaacgcaattggactcgtcaaggccgctaatatcgatgtaaagacgcccatcataccgcctgcagccgctatttgaaccgatagtagcccccatgcgattttcaacgaacctaaaccgacgagcgcacctccgattcctgctaacaaaacgccaaggacggtgacgacgcctagaatagctgctgttaccgctagcgtgatggtaacgaacttctgcatacccggcgataaattattaaacgcgtctacaactttttgcaaaacggcaactagcgcggatacggccggggttaacgctttaccgacatttatttgtgccgtctcgaatgcgcctgataactcttcgatccgtcctttcaagttgttcatacgctcggccgcaacgtctgccgctttgatcttatccattgcatttgccatttcggtaaaacctttagctccagacttgccgaggattaatgctccgcggatagcgtcggaaccgaaaattttgtacagtgcttcctgtttatctttggctgacataccatccaaggccttagagagttctcctgatatctcggtcatacttttaatgtttccttgagcatcgaaaaacttattgtccatcactccaagtgcaatcgatgccttagaaaatgctttttcaaatgaggccgtacccttcttcaagccagttgtcttggtgacgtatgcatccatcgctttgtaaatatctccgagatcttggctagctggtttaaatccctgtttagccaaagactcaaatgcttttttcgtatctaatgaaacaagaccgagtgactccattgttgtgtaagcaccgtctgtcatcggcactaaacgacttaacattgttttcagtgatgttccagcatcagatccctttagcccattctgcgcaaatactgcaagcgctgtagatgtatctttaaacgataaacccatacctgcggctaccgctgaagtcatggacaatccgtacttcatttctccaacagaagtagccgaagcattggccgctcctgctagaatgtcagcagccttggcaacacttaaattatcgtctctgaatgcattgagcgcagtagaggcgatctctgcggcgtctgccaattcaagatcaccggctgtcgctaaggaaagtgccccagaaaggccgccgtccatgatgtcttttgtagatacgccggctttaacgagttcttccatgccttgcgcagcctctaacgcgctgtatttcgtatctgcaccgagtttaaccgccaggttcgttaaagcctcgctgtatttattcgcctctgccgggtccattaccgatttaacgttcgacatttgctgctcgaagtccatcgatttctttgtcgcgaggccaagagctccgctgattgccaacgtcgctacaccaaaagacgtcgcgatttcagagccaatcgactgtaatttaccgccgatcgtccgaaggttttcgccgctctcttgagcttgcgttcccatgcggtgccacgcgttggcctgctgttcaatctgcgtgttagtcgctcttaactgcgcctgcgtctcgcgaagctgtgcagtagcttcgttcattcttgcgctaagttcttgcgtttcctgagcgtcttcgccttttgcgcgcttggcttcgagatacagccggcgaagatcttttaagcgttgttgctgaagatcaatcgatttatttaagtggtcggctttctgcctcagttgatccgaggtcgatccgaagttatcaacgccagccgttgtcgctttgaacgctgcatcaagcgcacgcattttcgtcgtgatcgtattgacgctcgcacttagtttagcgcccagttgtgcaaatcctgtactctgctctctaatccgtttattaacgaggtcgagttggtcctcggttttcctcatggccgctaatgctttgttgtactgcgtcagtaaccggacggaggcagccgcatcttttcctttcgtttgaacactttcttcgtactggcgcttaaggtcggacagcttcgctttgtgtacctgaagcgtacggttaagcacgtttgctttctgattgagagtatcgagactgttatcgaatttacctgcaccggccattgttgccttgaactcactgttaagcgctccaagtttacggttaatatccgcaaggcctcgcgtcaagtctgcgctgtccaatccgatactgacgcgcaaagcgccgagtgattccgccatgctttacctcctttctaaaaaccgagtacctgatcgatatagacttccttcttcccgccgcttgaaccgccgcgcttgttttggccgctatcggaatagtgcataagctcgaagaaccaaccgatatccatttcgtcaaagtaatagatatcttgtggacgctccatgttatcgagataaagttttttaaggtcgttctcaagcttttcgaggaagtctaacgggaaaaggtaccccggcgttagttttttgccggagtctccgcagtggcttcgccttcacctttcgcagcttcagactgttcaacgcctgcatttaccgtcccgacaacgccctgaatggtatcggaaatagttggaatcattttttcggaagcaatgccgtcgtagaattcgtcaagtgagaactggttgtcataaacacgaacgacgtaatcaacgaggttatcgagatcgccgacatctagttcgtcaaaattgcttgttttcgatagcttgatagcttcgcgaagcattcttcctttaataaatggtgcgtgaaataccttttcttcacctttgataagtaatgtaatttgcatgcaaacactctcctaatttgttgttttttgagtgaacaaataaaagagagccggccgcagccgaactctccgatatgaatctattactcgcctgaaggcggtgttccgccgccaccggtagatgcggaaggctcgtaaactttcgtgaaccattcgttaataaccgtctgattaacgccttcacctttcgtgtaaactgaacggccccaaacgccatcaaactcacgacgcatgaatgttccggaaattgaatccgtttggaattccggactatccgttttagtagcgaactcttcttcctgtaactggaactttcctttatatagcgcgtaaagcttatcgccgccgcccgatacttgcgatttaaagagtaacgcaccgtatggcgccaaatcggtgtctttcttttcaagtacgccatcagcattaaccgtatgtccgagtaataacgcctgaatgtcgtgggacaactggtcaacgccaatctctacctcaacacctccgaaagccgtttcaatctcagacggtccatcatccgcgttcaaagtttcgctgtttgtgttcggtgaaatagacgcttcaatcgccttaccgatcttaaccggtttatcgtaagtagcgcccgcttcatcgtccttaatcaatttcgcaaagtaaatatcgcgtaatcccatgcgtgttcctgccaaatttattcctcctccgtattttgcgcataataaaaacggagaaccttgtgatagatctccgtttcatgttcgtataggtcgtactgccctaagcgcccaaagcccgcatcgacgagctgtttcttaacgccagtttctaaccgagcgtattcgcttgggtccttcgtataaatatcaacttgaacgtaaaatcccgttgcttcttcagcgtcttctgcattgagtgcgctcttttcgtcgtagaagaaaaaacggatatacgtttcatcctctccgcggtacttaaggaaaacaacgggcacgcccaacggtttaagcgccgagttaacgattgcccgcgcactcatcgaaataactccctttctaaatagcgtctgatctcgcgctgtgcttcgttctttttcgcgttgaaagacggctcaataaaaggcatcgcttggtgtcccgggtgatcgacttctcttccgtagaatgtagatccatcgctcatgacctttttgttcttcgctttttctaagtgcggactggtaccgaactcagcgaatcgcgatataaaatcaaggtcgcttggtccgatttcgataatgtcgttcttaacgtcgctgaccaggatcttactttgtgcgctaggcttccgcgcttccatctcttcaaataccggcttagcgccggcctcaagcgcgcctttcttaacggactgagattcccgtcccatccggtttagcctcgccatcagctcgcgcatgcctcttacgttcgatcttgagctcacttaacgtcgacctccttcgcaataaccgtgaaggtaacgtttgcttcgttatcgttgataatgctttcaatctcgaactctcgtccgtcatatttaacgcgcatcttgttattaagcagcgccttaatccgcttggaataacgaatgataaaacgggtcgtcctctcggcctgaattgtggctgccgcaataaattctcggccctgtaacgtctttactgccgaccaaaccgtggcaaccggcgtccagccatctatctcaaacccttcgtcattcgttgtgtttgcgtattgcaaaaacgtgatccgcttattaaaacttccgatgtttaccgccatagcgctcacctcaattgaaggatcataccggcgatttttgttccgctgttagctgtcgtcctgttttcgtaggcgtccgcaacaaagatcagtgccgccattttgtacaggtccgattcggtatcctttacgcctgcgttttccatgtgcttttctgctgcggaaataaaaaaggagacgaggttatcgtcctcatctccatcaatccgcaagtattcttttgcttcatcaagcgtaagtgccatcgttattcacctgccggttcgttgaccgtaatagccaccgttttcttaaccgaaggtttcgacttagacgcgacagtgatcgtggttgtgccagccgctttagccgttactaacccggagctagatacggttgctgtcgcggtgctgctagacgtaaaagtcacgctttggtctgcgcttgaaggcgtgaccgttgcgttaatcttatacgtatcgcccaccgttaaggtcttggaggtttccgttacgttgacgcctgtaggttcggtcgctaacgtagtcaccgaaagctcggcgctaagtggcgacgggtcaccggtgttaggaattgcgcgcacctgatacttatacgttgttaattgcgtcaagccgctgtctgcaaacgatgtccctacgcgagatccgatagatactccgtctctgtacacctcgtattctttaatgcccccattgaaggttacggcgtcccaattgagggacaccgatgtgtctttaggagtcgccgttaacccttggggcgcattagggcgtagtttcgactttcgcgatacggaatgcagatttaagtttgattttgtgatcaaaatacgcagtcaatacgaatacgttttcgccagttttaacgtctttatcgctttcgtaagtgatcgctggatcgtagttgaagtgagagtaacggaagtcaccaacgatcgggctaactgcggcatcagagaagacgaccggcttgccgagaatttgctcaggttgtgcgctgtacagtgtggcgttaccgttcgcaagagtttcaacgatattcatgtaatcagagtagcgcatcatgattttagcgttttcgcgataatcttcgtgaagatctgcggtagcttgcttaatcgctttgtattgatcatccgcagtgatttctttaataccagcagcatagaaggacatttcttcttcgccagcaatcggagtcgcagcgaatgcaactttcttttctttcgcagctaaaccggattgaagagcgcgttctacagtagaaactagcgcagtgtcagtcgcagctaggatcgtctcagatacgagcgccataaccttgaatttatgacgaccgaaagaaagtgagctgccttctactttcaattctttagcagtctctaagtcctggatgaaactatcatcatccagagtaaaatctactttaggaagctctaagtttgtaacgttagtgtacgtagatacttcgcgcagtgggttcttaacgaacggctcaagcagcaattcttcggaaacagttttaggaagtaatttttctccaccagttccgttaccgtcgcctaatgctgcgcgaacttcttgcgctggaacttctttacgcatagtcgcacggattaaacctgctttagcagatgttttttgaatctttggatcagagctcgtaaggccttcggatacgcctgctttagcttgttgtaagcttgcttggattttagctttttgctcgcgctctaaagaatcgtgttggttttgtagaatatccatacgctctttaagatcgtcttttttctctttaagagctcttacatcttcgatagaagcgtttggatcagctgctttattcatgatttccttctcgacagatgctagttgagtacctacagtatttaagttagccttcagatcaaatagttccattaaataattcccccatttttgagttttagtaagtttgtttgtgcttccgcgataagctgctcgcgttccacgcgctctctttccgcctgtttttcgtcttcttccgtttgattaagtaaagcgtccggagtattccggtaactcgcgaataacttcgtatctactttcgcagccacttgttttggagcttcgatactgtcgcaaagccctaattcgaggcattcctgcgctgtaagccacgtttctgcgtccaaaagagcgattaaacgatcacgatcaagcttttcgcctgcctttccgagataagcctcgacaagactttcgcgaatgcgatccatgtcatcggcctgcttgcggagttcgtccgcgtttccctgcgctaaggtccacggattgtgaatcatcatcatcgcgtttgcgggcataaaaatagcgtcaccggacattgcgatgacgcttgcgatactggccgccagcccgtcgacgtaaacgttaacgtaggctttgtgccgctttatgatgttatagatcgaattcccttcgaaaacggacccgccaggcgagttaatatagatatttagcgttgaaacgtcgccaagttcgtctaaatccgccttaaaagtctgtgctgttacttcatcgccccaaaattgagccgaactgatttcgctgtaaatgtaaacctcgccagctttagcgtcattattcgccgctttgatttcccagaacttctttatcgtcctcacctcctttcgagtcttcgttatcatcttcgttagtttttaacgttggaggcgttggcgcgtcggcgctcgtaattttctgttgcgcgacttggtcgatcgggaataagtctttgctcaaataaagcgtatctccgcccttttctggcggcaaatcctcccatgcgcgcacctcattcggcttaaaccagccgctccggatgcctttttggtagaaatctccgcgagtcctcatgtccccccgcaataacgcgttcatgttgaacttaaaataataaccggccttacgttccttttcggtcagtaattttcggttaaattctttttcatattgagccgcgataggcatcagcgttccttgtacataatcgatgtaaagctgctccatgttcgatacgcttccttgcgtttcgccgagcatgtataacgggatattaaaagcctgcgcaactcttgaacgtgttaccttttcgacttcaaacgcttttgtatcgatgaattccttttttaattcgcgtatttttacgccctgttcttgaattaagatgccgccgttatctctatagaagcttttaaagttctcgagcatctccgttttccgcttctcgtccaactgcgtagctaattcgagaatgaacgatatcttagcaccgtccatctgttcgagactgaacgtccttacatcgcgatcaaagtccagcgcattccgcaaaacctttagcggcgagattcctttcagtccgtcaaccgacgtatacttaacgtgaatcatatccatgttgtgaacgaaatagtttccgttatcgccgaatatctcgtaccataactcacgagacgtttcctcaatgaccggctgcactcgcgaagggtctaaaacgtcgagtccgacgacttcataacgcattccatatcgttttatggcgtacgcattgccgtaaaccgcccgatgcgtctctaaaagcccgatcatttcaccggaagtcatgttatggttcggcgcgtacgttaatagttcggatgcctgcgactcaatcggctgataattcttgtacgctttgatcggcaagcttgccatcgtgtttgataaccgcgatacagccgaaaagactgtttcgttatcagccaacgcgtgctcaccatagtttccgaaaatactagcgcgagggataaaccagtgcgcgagatcctttttggcggccgcctttgcttcaggtgcgcctctgaaaaagcttcgtaagttactccaaaagcccaatttcctcacctcctaaccgtttaatagatcgttaatcgagataaatccgacacttccgcctgcaaccggcttcgtcatgtcaagatatacctgcgaatgggcgttaaggaacgcagcaaagccgtctatctttcggtagcgcgtctgcttggtcggcagccagtttccgttacgatcctcgacgagtttgacgttgtttaagtaccacgtgaagagtttgttttcgttatatacgactcttccgtcgagtaataattctttaacgttcttcaatggatcgctcagcgtaatgtaaccctgccgcacgacttccgtttgaaatccgtaattctgcaggtcttgcaccaaccgcatcgcattcgccgggtcaaacgtgatcttttcgatctgatatttgcgcgacatttcaacgaaccaatcgtaaacgtactcgtattccacgtattcgcccggaataatcgtcaaataaccgtcggtttcaaacccacggtagtcgattttttcgttatctttttgtacctttgccgccgggacccacgaatgagacaaaacaaaaacgcgattatccggcaagatgaattccagacacgcgctcgtaaagtcttccgtttgtgataagtcgaagccgccaatgcatctcatgccacgcaacgattccggatcgacccgtctgttattgcgcttgatgacttcgaagtcaataaagctttcttcgccgttgtcaacgaagatattgaaccgcttgaccagccagtcgttgtattcgcgtggtacgtgtcggtccgcgttaaagtcttggatcattgacggaatatccatcgttacaccgatattggggttcgctttgatccacatttcgggattttcgacctcggatatgtcgtctaattccgccataaagtagaaattacgctcctgaacgttgcttccgtcaagaacatcggaggcaatttcgtaatattcgactagaggtccgtcgagctgatagccggccgttgtgatgtaaatgattaatggctgggtccgcgcagcccttgagttcttgattacgctgataagcttcgaatctttgaattcgtggatctcatcgaatataccgaggtgtgtatttaagccgtccaacttttcgctatctgacgcccgcgcttcgatttgactcatagacgcgtcgtgatagatgcctttctgattctcgcgaatatgtttccgcagctttggcgatttcctaatcatggctcgactctcttcgaaaagcacgcccgcttgctgcttcgagttggctaaaacgtaggctctggcgcccggttcgccgtcttttgttatcgcaaagttggctaaaccgctgattttcgttgtttttccgttcttacggccgacaaatatcaggccttcgcggaaacgtcgtagccccgtatcgcgatgaacccaaccgtacagcgatcctattacgaagtgctgccacggctgaagcgttaagtttgaataacggccctgtgacggcttgcagtaccgctcgataaattggatcggacggtgccctttttcttcgtcaaagacgtaagggaattcgtctgtaccggcgcgttcaagatcgcgaaggtgacgtttgcaagcaagaatatttttcttactagcgactatttcacctgacgctaccttttccgcataccaagtcgtcagcaacttttcggacggtttttcgcgtataaatccggctattttttgcgtttttagccagttttcgtaccatttttcgacctctgtagcgttagaatttactgaaatcgtcgtcatcgtcatcaccgcctgcgtttaattcttttcgctgcgccggcgttagatcgagcgacttcagaaggttatttaatgtcgtaaccgtcttcgtaagctcaatcgctaacggatttttgacgaggttttccgcgcctgccttgttcgtatgccgcatcattaaagggttttccgccacttccttttttaatcggcggtagaacttatgcgtatcgatataaagttcgataagctcttcgtccgattccgtatacctgtcgccaagatattcgcgcagcctttttgcagtgggtaccgccataggatcgctcctttcgtccggggatttaccccctttaatgtaaaatttccggtcgcgctacaagcgaagtggccccgccggtccttacgtttttgccttcgaaatcccaacggtaggggggctatagctccggattagcctgcgccttcaccacgtttattctgcgcttcttagccgttttcgtagccggtccagcgcctttttccgggtgccttcggttgtggcacggattgcacaaacttacgagattttcgagcgttagcgcgagttccggatgatcgcgcagttctttgatatgatgaaccgtctgagccttcgttatcttacgttctttgagacagtcttggcatacgttgtggtcgcgcgtaagagccaacgctctgcattccgtccatgccttcgacttatagaacgctcgtgcttcgggatcgcgcttgtgtttgtcgtagtagttcaaggcatcgcctcctttcgcatactaaagcgtcaatcactctacagtgacttaggccttcgtttgttcttattattcttttaagtacaatcgcgataaggtacttaatagattactaatatctgcgtatcgtatgagcgtaagcgaatagaggcgctattatttgtttgttattattagttcgttattattacgtttgttattattaccgtcactctacggtgatttacctaaatcactctacagtgattaacgtaagtcactctacggggattgaccgtatataacgtccagcctccgccttacctccgcatcactcagcccgctgtaatattgcggataatataacttctcgcgcttattcgacgcatagtcatacgctgtctttagtagccctaccgcctccaacacgttagccaaccgcgctatcctattgcgccctatccccgtatcctcagcgatcttatccaccgaagggaacgcgctcatataccggtcgttatcaacctgcccgttcacatgcgcaagtaagtacgtatacaattgcgcgatggctccgttacctttctcgtattctctcgcgataggaaccaggcgccgccataaatcatgcggtataggtgcattacctgtcaggccgttttccttctgcatcgcataagctttccgttgcagcgactcctgcgccaaatgttcgaattggcctcgcattgactatcgacttcctttcgttaactaatcgcgctacttactgcgccctcgcattcgcctttctggcgtcatattcgtcaagcaaagcgccaaagtcggcgtctctctcaaatacccacatccggttattagttcgcggatgtagcttcgtaaatttatagcggcggccattcgcctttaagaagtgcatgagcgttgttgagtagcagtaaaataatccgttcacttaacatacctcccagttaattaaaagtcgcgattacgcatcgcatacaaaccggctataatacggcgccgttcgcttcctatccgaaagccatcgtaccaataatccatttgccgtatgactcgccgcatctctacattgttagccttacgtaaatgttccggtgcataaccattgtcgcgtagccatattcggaacgtatcgtattgcgttttgtttaaggacggccgactcactctgcgccctcctctacgtaaatcacttcggctgccaacttaacaagccactgaaaatgcggatcttttacgattgggttttcggcataaccaggcagcataaatagcgttgcattttccgcgttgatgccgtcaattccgccaggtctacgcgatacaaattgcgtgtacttaaagttcggatatttcgttttcacacgtttccataccgcctgagcttcgttaacggtccgtcctacaacgagagctgtgcgccatttctctttcggtgcgaaaaaggctcggtgcaacgtatcgagctgttcgttgaattcgtcgctggcggtgagtttaacggttatcttttcgctcattggcgctcagcccgttttattttctctttactagcagaagcaaaatagaaatcgaaaatgatagcaagtggaaacagcggtatctttattagcgtaatgactaacgcaatcagtaaagtcgcggccgccttttctttgtcgacctgctttgttcgtaatagttcacgtagctcatcgtcagacgatccggatacatataaagacgcgatcgtaaatttaaacataaggcccgcgtagatcattccggcaatgaggtaaaccaatagcgcccccatcaacgatcgcccttccggaagcttactcggcgaatttctttcccgtcgagacacaatccggcatcatataccgcctgctgctcctcccgcaattcagccagcgccttagtcgccgcctttgcttcgcgctgtagcgctttgaggccggttattgcttcggatacctctacgtttacttttacgttgatgtcacccgttgcgtagatatttccggtttgagattctaggctgaattttggagcttgatatccgtctaataaggagtagcccggtttgtttgtagctacccccgccattactgaatttcttgttgattcgcgtttgtccgccattcattttcctcctttaattaactctattagctctgttgggacttattaaaacaagagttgtaatatctgctgtactcttctacactcatacaattaactttggctaaatagcttattaagttgtcaaactttactgacgacaaattaaatcgatctttattagcctcaaaccactcaaagatatttgagttatatttactaatatttagttccgagctaagtgggatcatgtttccttttgttgttcctccgaatcctgtactcagcggtattacgtgatcccaatgtatatttgaagattttccagttaaggcacatccgccaaagtaatcttgtatcttgagtttatctgcctgagttaagtcatttggaaggtctttaactttagcgcgccttttttgattctgtagaataatgcttattgagtttttcttttgccatctcttcttcagtattgcgtaatgctctttgcgggcagagcagtatgctcggctgtattcagctcttttttgtttgtttttcgttctgtattcggcgtccctcttcaatttacagtagttacattccgaactacgtccggcaaatccttgggattttcggaaatcagtgagagcaaaaacatcaccgcacctcctgcaagcttttgcgatcacctgtcccgagtgagactcatagtacctggttcctctactagttaccttttctgccaaatcgggatgcattctaaaacgcctcctattcggcagtctcgacataaattttcacagggcctgggtatacgtgtctcgtcatatcaacgtcgatagttgccacttctgttggtgacacttcgataacctccgtcgtttcttcgctgtttaatatggacctgttctctcgcctaatcgcagatataacctccgcaatctctttgcgcaccgcatgtccggcagactgcagcgcaatcaggcgatctagatatgcgaacaattcctctgtcttcgtcatcttcatcgtctccttttcgtttcttaaagcgcgcttcaacgtgaaacccgctttagcacatacgcaagcacgaaaagaccgccaaaatcgttggcagcctcgtcctgtttgcggaacgtacagtaaaaacggtagatctgcgtacaggttgcgatcctatacggtgagacagtgtttgcagctccgttttccgccggagtacgcaagcacaaaaagacctccgccgtgatggcggaagcctcgttctgattgcgtatgttggcttttagcaagttgcgataacttgacacgccgccttggctattcgtttattatgcgggcgaggatttgcacctcgcataagtttacggccctccggcttgtctgcgtctacctattccgccaccgcatccgtgatttgcccgtatattaacggacgtagtaaatttcctctcccgactcagccgcaacacccgctaattccgcaagcttttgaaaagctacgttattgactaacggtcctgcctcgcattcatatccacaatctttaagctgctcgacgatttcttttaacgtattaaattccgccattcgattcgttcaccctttcgtaagtcttttcgaaaatgtccggcttgcacgggtaaagttcgtcctcaatgccccgaataatataatcgcctacttgcgcaatgacttcgctactcggcgttataattttgagtctattggatgccggatacacaaagcaccgttctttgtacgcctcatccccgataaatttccgtagattatctatcgagtcctgtgtaaccccgccccattttagcgcttctatttccgcggcctttctacgatatttcgtcatccttccgtcctcctttcgaaatcgcacgaaagtagcgtttctgaccactaccctatcgaatactctccggccggattaaaacggctgtggcgtacttatttcgcttttctaacgtttaggatctcgcaaatgtatatatccgtttcgtcccaataatcgtcttcgtctcgctcatcaagatcgacgagcgcttcttcgtatgtgtcgtatgtgcaaggagccggatcgataatagaatcgctaaatactacgtacctcattcgcgaacacctccgtttgatatagcgccgcaatatgtattaaaaggacgccaagttgcggctagtgcccgttgttattccgtaggggtggcgtcctttaccgtacatactgaaaacctcaaacctcgatcgagcttcataacgtaagacagcatattggacactttaacaagtatttttcaaataaaaaaccaaattgttttcatccagtaaaaatcaccggacaacgtaatttggcttctctttatattattaaattctaatcgcgatcaaggtgctaagtaattaatatctgcgtccgctaatgagcgtaagcgaatagtggcgctattatttagtaagtctttataagtaagtatgtatagtaattctttatacgcagtgaaaattactggaacgtccggtgaaaatcgctgtatgatccagtaaaaatcaccggacaaatccgcctatgcccgcatcgacagtatttttcccgccaggaacaatccaacgaccgccttccgtttcagcatcgccaagtataaccgcctcgcccagctctcctcgtgttgcagcgctatcgaaaccgccttccctacattcggatgttcgactatgcgcttaatcagcgtcaacttttcgcgcactgttttacggcagcccggtttgaattcgttttgtatacagccgttaaccgcgatataacatttccgccgcgccagatctaccgcaaccttttcgctatacaagccccaccgttttgcgtaccgttcgagcgtatcgctatcgatgtacgaatcgaatagctccggattatattctcgcatcaaactggcgtcattgatctgccggtaatggtacagcggcctgttgatatagtatgccgtctgacaatacgtaaacgcgtccatgttgaacagccaatcttcgccgaggtacttgccgtcagggaacgatatgttatgcgtatcgagcatgcttctgcggattactttgccgacgccgccgtacgatccgttatataagaaatccgttaatatagtcgctttaatctcggcccgtccgatcggctcattcgcttttgcgctataacttttcgtatagcttttcgtctcgtcttcgtaatcccaacgcatgtccgtaaacacaatatctgcgttgttttcgcgggcagcttcgtacataatcgcataagcttccggctcaatccagtcgtccgagtcgataaacgctacgtattcaccacgcgcctgcaggtcgaggaggaaatcgcatgaaacgtttatttaaatcaatcgtaatcaccgcggctttattgacgagtactatcgccttagcaccgcaagcagacgcagcatggtcgggctggcagacggagaagttcggacataaagcgctcgtctatacggatgcaactacgtacacaagcagcgcaaagtcggtcgattggaaggccgaaaagaaaggcgcggccacgctttattatacggccggcgtatataaaaagcgttcaggtggcgggctggctgatacgggtttggtgcagcgcggaagctttaagaccgcaacgccgctgaagtcgtttagcgtaaagtcgattcgcggtaagactggcgctggcagttacgttatccaggtcgattgttatacggattcgggcaagcgccattatgtcgggacttttgagtcagcgcgtttcaacgtgaaataagcgtgtgtgagccgttttaagctgcgaggtacttagtgtacctgatctgcgctaaggcggctctttcgctttgatttcgtggtataatcgttctatatggaggtttaagcgatggaaacgaaagactacgaaacaaaaggatacgatacgagtataacgtacgaatataaggaaatgccggacgtacgtgctggtcgttgcgataactgcgactatacgttgtttaagagttcggttaagcacgggaagtttttgcgcgaatgtagaagatgcggtatgaaaaagaatatttaaacgcaaaaagaaagacgccttaataggcgtcctttttcgttttatgctcctctaacgataccctctagcggactagctccccgtggcattccgtataattgcggccctgcgcccggatttaattctcccattcgcctcacctccgatatagtaaaattatatcacgcgagctttccttttcgcacctatattcgaccatatcgcgtcctgcttccgtttattctcggcagcttccggaaacatgcgaaaaaactcggcttcgtcttcgatgggcttgcggaaataatagacgagattcttcgcgccgcctccgttctctaccgtctgtataagttgcgcctggactagcgttttgaccgcgttacgatacgttgagtcgcttatagccagcgccctagccgcctgttcttgcgtcggaaaggcgtaaccgtagtccgcgttataaaacttcagcagaaacgcgtataccaacacggcgttaccgttcagcttcggaaagtattgataatgcgtaagaataacgttaggtatgcccgtatagcccgccgcagtatcaaacggtagggccttcgctttatcgctcatataatcgtcctccacttaaataatattcgacttaagccggcttacggcgctgccactccgtcaataaacgatcgagttcgggcgttcgcgcatattgccaaaacttccgtaaagtattttcgttcaagcctacgcagatatatcgttggttatggtcgcgcaggaattcgtatagattcgcagaatagcagtaataatagccgttatgcattcggtcgcacctccgtaattagataaataaaaaggcgcctatgcgcccgtatgctctaccctttcgcctgttgcgatattgaccgtaaactgaccgtccgtgcgtccgttaatgaaatcgttgtagcgcttgcggcgttgtttgtttagagatttagcgcgcgcatcaacgaaaatagattcgtaggttgataacgaccggcgctttggttcggcacgattgcgaccgttctgatcgtattcttccgcaagctttccggatcgttctccgttcttgcgcgtcgtttccaggcgttcgctcatgatcgggtattccgccttcattttatttttattcgtatcggttaattcttcgaaaagtacgagatctgccatgcgatctaacgcgatggagtccggctctttgtcagtcgcgtccatataagcgtcagtaagcgctgtgattcgttctaggcgcgctacacgatcggaaatatagatggaccgcaagccaaggccggcgtgatcttccgacttatacgcaacaatttcgccatcaaccaatacgcgatcgccttcttgtggctgtccggaaacgcagcgccaagctaatggaccgcccgtcttataatcgtgtctgacgtcgagctgcaattccgtaatcatttcgtgcaataaagcgttatccattaattcgtcccccttatcgcgtagccttcgccgtggctcgcccagtagtaataaacatccgttaaactatcgacagctgcgtttaagtgaaatacgacggcttgttgcgcaatacccatccgttcgcccgcctcggtttgcgttaattctccgaagtaaacgagctcgatcgcctgccgttgccgatccgttaagccggcgagctcgatcgctttatgaatatcgatcagcacttccacggccgcatagtcgccgcatcgcttccggctgacgaacttctggtaatcggcgagtaatagcttgacgccttctgcgttatcgagcgcataggctgcgtcgaattcgcgttcctttcggtgtagatcgattttggtgacgcccattcgtaaaacctcccgtctgcaatttagtgatcgcgacacccttccgtatagttgcgaaaaagtgatgtcgtataagaaaaggctgcgttcgcattttgcactcctgttccgatgaacattttcgaaaaaaagtattagctgaggtcgtttttcctttcgttgactccttcgttaatttcgtttatgattaacgtaaacgcttacggaaggagtttcatttatggtccttacgtggatatctaacgactttgagcgcaacctcaaagcgtacataactatcgaaaagcagcgccgtctgtttatctcggcaggagctcgccgtgtaatcggcctgcctacggacggtccgttttatcttgtagtcgcatatgaaccggagtcccggcgcatcgtggtcggcaagcccgaattagtaaaccaaccggacgttaagccgttcaagttcgataagcgcggcaacgtatcagccattccgttcttacgtaaggtcggcatcgatttcgacagcttaccgcaacgctattacttgatcggcgatggtgaggcgtccaaacaaccgtatttggcgtatccttcgcatacatacgcgtttcagttagacgctgacgctaattgatccgccaaggcacatccgatataccacgcaacacgcgaagcgattccgttaccgacaatccggtactgtgccgataaggagatatcgtctggcaggacgtaagtgtctggcgcagattggattcggagacactcacggacagtgaaacggcgaggtgcttcggtcggatggatcggctggccgctgttatgatgcgccggaatcgtattagacggtttatctagcgattgcacgcggttagcttggccgtacgtgtattcgctttttggcgcccaatacttcccgcagtcttgacgttcgggttccggtaaatctccgatcacatcccgcaatactcgcgtctgataatcgccttctaacggcttcggaaactcaaacgtaaatccaagatccttccgcacaccaacgataaacacccgctctcgcttctgtgctactccgtagtcccacgcgctcagcgctttccactcaatctcgtaacctatttcgttaaacttctcgataagcgcatcgaatgtaggacggtggcgcttcgttatcaatcccttaacgttttcaaacacgaaggctttcggctgctttcgttcaatgatttcgagataccgccatacgagtttaccgcgttctccgtctgctccggcacctttacccgcaaccgagaagtcttggcatggtggccctccgaaaacaacgtcggtatccggcaagctgtcgatatctactgcgctaatatccgcctgttcaacgtaatcaccgaagttgtgacggtatgctttaacggcgttcttatcgaagtccagcgcctttacgatatcgtatccggcggccgtaaagccgattgcgccgagtccgcctccgcagaataattcgagcacagtcagtccgttcgccggctgttgcggcgttaaattaaagtcgcccatgtattcgctcctttcgtgttcctctatacagcatgcgttctttccgccagtcgttgaagcgataactgtataggcgggcatgttaattcggcttactgatgccggcctacctttccgaccctctgtccgtactctttagtcggcacagcaccgtaatgattcggaatctccgtcacttaacgcccacctccgccattaaatcgtccaacttcgcatagagctgctcgtacgtcccatcgttcacgatttcgtaatcaacttcgaaagtttgcagcgctttttcagtcggatgatcgagcgctgctaaatcgaaatcgtcgccggccttccgtgcgcgttcaatccgtaattcctccggcgctgtgatgcggacgatagtaaatccttcggcgcgcagccggtcatattcgttctgctgccgaacgtcttcgatcagtacgcgattcttcagggacggtgctaatccgcaatcacatttgcgagaaaagagcgccgtatatgcgtcgactttcgccatacatgcggctatccagacgttctcgccgagtatcttccgcaccgcctgaccgaattcttgataatacccgcgcggcttcggcttttcaggtacggaagggaaagcgcgatgaaaggcggctttgagttcgtcactgaaggcgaacgtttggaaatcgtaatgcagcgataaatacccggcggcttccgacttgccagcacgtaatggcgcggttagagcgagcttcatgggcgcatcaacaacctttcgataattgccgccaattcatccgcggtaaataacttttcgcctttaactccggtcgcactttcctttaaccgcgccaattcctcgccgagcgtccgtttgtctttaaacagcgtgtcgatttcgtctctatggcgcgcttgttcgcgtttaagcgattgaatattatcgagaacttgacgtctttgtagaacgtctaacatacgttgttgatcgctcaccttacgcttcatttccgcaacctcttgcgctaaactggcgataacgtcgattgggtcggctggcttcggttcgtcttcggcggcttcgaccgggacgaggacgagataatatccgtgagagaatccgatccacactccttcttcgtcttcatacggatcgacttctactccttcgtcatcagtcttacgaacctctctcgcgattccattcgattcaccttcgtacaagtgaataaccttctcgcccacttccgcctcacgttcgaccatttcgtaacgctgaccgtcaatgtgaacgatgtcggtcggttcgagtacgtgatattcttcgcgaaggataaatccgtcaatgttgccaccgcatctagcttcgtcactttctacgtgcgactttcccgggcggtgtcgatcaactgtaaaaacatcgccgttctcgtacccttcctcgagatcatccttctccacaattacgatcttctcaccgacctccgccttccgatcgacctctacgtattcgcgcttgatgccgccaagtgtttcgtcagccagtacgtgaattcttgcgtttgcgtttacgatatccttcgccatattatcgatattcctccttaatattcgatcatattctgatttagctctttccgcctcagcgctgaaccaacccatccgatcacctcttccgcacatatttcgcaaagacttggcgtgatgatttcgtcgagaagttgggcaacgtaagtccagctctcgcaaggtcgtcaagttctcgtttttctcgcttggtcgggtattcgtctaagaagcgttctgtaagcgcgattaaatcctttcgtgttatatccgccaatacatggaccccctcccgttaatttattacgcgaacctgcaccggctgccgcccgaactgtaccgcgtcggcttcattcgcaactaatacgtcaattttggcgcccttaatcgcgctcccagtatcctgcgccacggctttaaacgtcgtgccgtctgcctgccgcacctcaaccgttgagcctaacgcaatcactgacggatcgaccgctatgatgcgcttgcctgcgtgatagatcgtatggctaacgtcgaggccggtcgctgttgttccggtacacccttccgcgcaataagccgtatacgcggtcgcttcgaacgtttgccagccggatgtttgtgcgtgcttatgcggcggattcttgcgcttttcgttagcccgcgccttgacttcgtcttttacggaagcaagttcggattcgagcgcttttatcttcgcatccttggtcgccagttcagcgtccttgccttcgataacagcctccgcctcttggagcgcgtattcttcttcggtaatgcgcggtgggtctggcggtggtggctccggtggcttggcggtcgggttcgtaagtaattgcgttgacatcgctagattcgttagtataccgataaaatcagtcctttcttaggcgctcttttcgaatataaaagaactcaccttcgcgatattgttttcgtttctcttttagcgccgatgcttccgtatcatgaacggaatgtaacgttacctttccgttacttccgaaatcatcggtacagtcccacagaagataaacgtattcgctcacgactcaaacctcctcgaaaaattgcgcagtccatggctccacgtcgaccacttcgcgtcttaacgcttcggctaattcggtaatttccgcctgtgcgccgcgtccctttttacgtttggaatagaacgatagcaacgcggtcagattcgcagtcattacgagattcgttgcggctgcgttcggcaggacggctctcgcatcttctgcgggcactccaagacttctcaactcgtcatatacgtcttgaatcatttccatagcgtctccgaagtggtcgactgcgctaatgtaatgcgtaaaatccaatgacggactgtgatccacttttttatcctcggtcactgtcggaggcattacgtagtcgaacccgccggatctatcatctctccccatccgcacataccgctgtgactggacgctgaagctaaaaccggcgcgatgccgtgtaagctgcgccaataacgcccggctgacgccttcgatcgcaaaggtgaacgagatatgctccaacgtcgacgtgtgtttggatgcgaagatatgtcggaacagccgatcggcatccgtgcctgcaccgccatctgacgctttggaaccgaaatactttgcgccttcctttgcaacgatttcggtcggtttgtttgcgctataacacgatctgattgcggttaaggcgatgagctttccgtccgtcgtatcaagttggctgagataattgaaatcgtagttacctacgctatctaattcgtcaaagctatcgtaaaatttatcgcttaactgcgtatgtgcgattagctgtacgttcattttggtttccgccatttattcgtcctccaatcgttgtaacaatcgtctgtattctcgtttaattgcgtttcggcttgcacctgcgatcgctagtgtgtacaagccaacttcgtgctcaagcttcgcgtactgttcgtccgagatttcgttcagattaacgaacaatccacgcctatttttcgcaatccagcgcaacgtagtttttaacggcttgtgatatacggacatgtgtagcgcaatgaatttcgtcgctctttcgtcaagtattcggaacgggaactgcatagcccatcgcgttttactacttttgcggggaagtggcgccatcacgacgacaccccgctactcccgaagccgcccgcccctcgatcgctatcgccgagcgtatcaacctccgtaaacaccgcctgctcggccggcttgattacggcttgggcgatacgatcgccttttcggatgatgtacgtatttttcggataatgtgttccgtcgatattctcggcctttccgttaagattgcgtaatctaggcgtcgatccccattcttctctcgcaatattatcgataatcactccgacctcgccacgatagcccgcgtcaactgttccgagctgcacgcgtaatttagtattcagcgtaatgccggatcgcggtcgaatctgcatttcgaaaccttccggaatctcgaatgccaagcccgtcggcacacacgcggttgcgcccggttcaataattacgtcctccgccgcgactagatcgaagccagcgtccgttgcgtgtgcgtaggttggcgtttgagcgtccggtgataagcgttttatatttacgttcatttcgtttcctccttcgtaacgtcctcacatataactgcgaggttaggtatcggattggcacgttttcctcataaatagatgcgtataaagttcgtagcctggacgcttattccccgaaataaaagtccgaatcctttagcgcctcgaccgtcgccttcttatatccgttacccttctgcgaaaagaagtcgtgcgatttcgtcttcgtactaagtccgttcatcacgatcggattcggcgtttcgtcctcgaaatacggatcgaacgcgaggttttgcagcgatttattcgcgttatagcgcatgaaccgtttaacgtcgtgcgtcagaccgaccgcatcgtaaagatcctcggcatatgcgacctcgttttcgtacagctccgtcagtaactcaaccgcaaaatcgcgtaattctaactgaatgctatgagcttggcggttataaatttcctgcgcgagcaagccggtataaacgccgtgaatcgcttcatcgcggataattagcgatatgatttcgccggagttcgttagcttgccttgccccgcgaaatataacggataataaaagccgctgtagaacaaaaagctttcgaggtataccgaagcgaccagcgccttatacagcgaaatatcatcgccaggttcaatcgcgttgtacaggccgacgatacgcgctgctttccgctgcaaatacggattcgtcttaacccattcgaatacttcgttaattgtttcggtaggcgcgagcgtcataaagatattcgaataggacttcgcatggactgcgttttccatcatcgccatgaaattcaggacggctttacgttggtggccggcgatgtgctgcgcgatgataggcattccggtatttccctgctccgtgtctaatagcgtcaggcccgcaagtccccgcatgtaggtcgcctgctcggccggccccaacgccttccacgaaaggaggtcgccattaagcgaaatctcttccggaagccagaactgcttaacgttctgcgcgtagaacatttgcgtgaagtcgtcttcgtgtcgcgaccaatcagccgccgtatggattgcgtttgcgttcgtcaattattcgtcctcctttttatatccgtccaacaatgcgatcagaactcccggcggaatattcgcgtaattcataagatcacaacaccgacttgcgtaccttctcaatttcgccagatcttcgtccgatagccgttgattcacgatcataacctcctcttcgtttaaacgacgcaactcaagcatgaatcctgaccggtgtcttttgttcgcgcataatacagcgtcttaatgccgcgatgatgcgcgtataaatcaatccggttcagatctcgcgtcgtcatcgtatctttcaagaacagcgtaaacgaaataccttgatcgacgtgctgctgaatcgttgcgatcatatcgacgactttaaacatatccatgtcgtacgcttccttatagaagaaccaattctgcggcgatagccccggcataggataatacgtcttcgaattgccatacgtacgctcctcgatgcgctccataatcggcatgaccgacgctgttgccgactgcacgtacgaaatagatccggtcggcgcgatcgtaagtctgtacgaatggtaaaggccgtggagcataacgttagtctctaagcgaacccaatcgatgcgcttcggaatttcaacgccttcaaacagcttcgcaaccttttccgttttaggtcggaaatctcccgcgacgtacttatcgaagtagctaccgtctgcatacgttgatccctcgaatccttcgtacgtactaccggtctgttgcgctaattcattcgaacgcaccagcgaccaataattcaccaacgcgaagaatacgttagcgaaatcccgcgcttcttccgattcatatgcgataccgttttgcgctagatagccgtgcaagttcatcgcgccgaggccgagcgagcgcatctcccgattagctcgcgcaacagccggcgcgttcttaatattcgaagtttccgagactcgcgtgagagcatcgacagacagcttgacgatcgtttcgaagtcgccgtttttcattacgttcgcaacattgagcgagccgaggttgcacgagatatcgaggccgatttcgtccggttcgccatagtcggtgtattccgatacttgcgacgcctgaaggacctccgagcacaaattcgaaaacttcaccttcgatatgtggctgttcgcatgctccgcgtttacgttgccttcgaacatgatatacggatagcccgattcggaacgcagcacggcgagcttttcgagaagcttacgcgcgtcgatcttatctttacggacggccgggttgtcgacgagctgatcgtacatctccccgatatccatttcgtctaggtgttggccatacgctttgtaaacggtatgcggatagaatacgtatgccggccggttctctcgcgccagttcgatgaatttatccgggataacaacgccgatggacaacgttttgactcggacgtcttcatctgccgagattttcttcgtatcgaggaagtcgtggatgtccgcatggaatacgttaaggtacgctgcgcccgacccttgtctttggccttgctgatctgcatatcggaatgcattatcgagaagcttcataacaccgacgacgcctttcgttacattctcgatgcccttaatcgattcacctttcgcgcgaatcttcgatagattcaacgatacgcctccgcctactttcgatagctgcatcgagatcccgacggctctttcgatgtcattcaacgagtcgcccacttcgagcaggaaacacgaaactaactcgccgcgtcgtttacggcccgcatttaagaacgtcggcgttgacggctgatattcctggcgcatcattaaatcgacgtactcaagcgccttggttgcgtcgccttccgcgaagaacaacgcacagcaagcgacccggtcttcgtagcgttcgaggatctttttgccgtcgttcgtcttcagcgcatagtcgttatagaatttgaacgcgctcatgaacgaaggaaaacgaaatttatgcgcgtaggccgcctgatagaccgccttgatttcttcgaacgtataggcgtccaggaattcggtttcgtagtattcgttatcgcgtaggtaatcgagtttttcgcgaaggtcgtggaaaaatacggtgttttgattaacgtagtcaataaaataagcgcggacggcttcgagatccttttcgaattggaaccggccgtccttctgtagcataatttcgttattaagttcgatataacttgcgtgtttattcgtcatgagtgtcctcctcaataactacgtgagaaatttcggttttatagaatattgtccgacgtttgtttttacgcccttgtatcgaaaacgttccttttctgtcgtttaacagaagctgtagttcatctccggatagactgacgttgtttattgtatgttcgccaccgtcttttaaataaatcgtaagtaaattacccaagcgcattcaccctttcgataaattgtcgtacatctacgtccgtgcccgctaattcaaagcgtccgattatcagcacgccgtattgtgccgctatcaaatccgcagcctttgcgtaattatccgcccatacacgatttcccgacgcagccacgcccgccaagtacgcgctattagctgtaagaaaatccgccaccggccgcgccacctgaccgaagccatacgtaccggtcacgcatacgaacggctcggcgatcatcaggcccggcttaatttcgacggttgctaggccggtctttgcgacgaatcggcggacgttgccggtcagcgagtaataagcgatcagcattcggaatcctcttcgtcttctaacgaatcgagttcgtcctcaatatcggcgatttgttcttcgatatcgtcaatatcgttctgaacgtcctgcagctcctcacgtaagtcttcgagatcactttcccttgaccgtagttcgacttccaacgctgatagcgcattttctagctcttcgcgtttatgcatccgatctacccctttcgtctctcaatttccgcctctacttcgtccaaacgcgcctgcgtccgttctcgctcgatacgctcctcgatcagtttccgatcgtggaagctgatggcggtatcactttcgatcagtttttcgttaagccagcgtctcatattccgcaaaccttcgtcagttgctccgtgaatcattcggccgttccctccgtttcgcgctcgcgtttatgtgcgcgatatggttcgacgatcagccataagataaaacggacgattccgtaaagtccgacgagaagcaggccgaatacgagtgaaatcgtaaagatcgcttttgctacgggagatgctatcgcccataccagaaatctaatcaacagaaagaacattgcgcccgtaagtatccacgaaagcgtttcgattaatctccgcttaaacatccgcatcactccaagtcgattttatattcggtcgtaatcgtatcttccggaaggtaaaactcatactcctcgaatcccgtactcttaccgtaaaagaatcgagcgaacgcagatttaaattgcacatcgtaagttagaacgtacggcttcgcgtactccccttccttcatcttcgaatcctcaactgcggctttgctaaccgttttaaacccgtctttctcctttacgaaatataaatactgcttttcgtcaactgttccggaaccaagtacgaagcttccgcttgttttagcgttgtctttaatcgagtagatctccgctttatgtggatcgactgttttcgtttcgataaaaaacgatggtacagccgcgattaaaaacacacccacaccacaaaggattcctataaaaatcccgcctaggacatcgaaaaaatcaataaagtaccacgaatccttgattgctagaattgcgacaacaacggtaacaagtaatgccaggataatgatccccatttaatccgcctccccttgttgctcgtcataagctttcgccttcagttcgctaatgacttcttcgatagcttcgttgtatatagaactaagcttgcggagggtctctgctttctcttcgactgtcagcacaacctcttcatccaaagcctctaaaaagtctcgatgtattcccttagcgcttttcccaaacgcctttaattccgactcaatcgtcactttagcgaaatacttcttcatttcagttgatgcgaatacgtcctcgaacattttaatcgggttcatctagtcgccctccttcggtttatcgattacgcccacatgaatcagccacgcaagcccaatcgcagccgcatcgctttcatcgaaattagcgaattcgccagtataaccggtaatgcgccgtaccgctgacgcaacttctttcttttctgcgctacctgatccggctaccaatgacttaacgcgtgttgctgagataccgagttgcggctgttttgctttcggagtcttccaatatttatcgaacgtcagcccgaatcgcgacgtcgcccgttcacacgcgttccatgccgccagcaccggatagttcgaggtcgacgttttgcctgcgaagtcttcccgaaccacatagtcgaagccatctcgcggatagtttttgtcgagaaacatcatcgcccacccttcgataacctccgccctgtgtgcgtgtgatcggctagaattcggcttcacgtgtgacagcgctttgatcgtaggctttcgattgcgtacctcgattatcgcgacgccggggcaggtcatcgacgtatcgaacgcgaggcatcggataggcttggcgctagtcatcggagctccttttcgtcatagtcatcgaaagttattttcgcatgacacgcctgcattttcccgcctttaaagtatttacgccacatatcgccgttatcttcgccttcccctgtaagcgtgatgagcacgtcagggaattgacgggatacttctcgcacgtcttcttcgtgtccgtaccatttcatctcgtaggcccatccattgaaaaccgcggtcaagcatccgttttcgtcatgattttcgttaacatattcgcgaactaattccgcatccttatccatctcgacttcatattgtgtaatgtaacccatcaaaccgcctcccctttgcgtactttttcgataaactctagcgccccggcgtactgcctttttgtagaatcaaagacgttcgaccgcttgactcgcgaaaccttatcgcgaatgtcttccagctcggccgctgtaagcgattgcgcaatagccgttttgtacccgttgaatgtccaaccgttaaggtcgacctccatcggcttgccgtcgtcaatcgaattctgaatttctacgaatctatcgagcagcacgtcgatgtcatcgcgtccgatttcaaggccgaacgcccggatgtccggcgacttttcgaattcgccttcttcgtactcccacgccttcttcgatgcgtttacgtagaggattacgtataagtcgacgccatacatctccgcataagcgacgcactgcttaacgtgcttttcatccggcttcttcagcgaatagaaagacgtacgggctgcgctcgtttgcttcgacttgatttcgaggcccacgcgcaatacttcgccgtcctcggtgacataacgcatgatgccgtcgcatgttccgaagaggtgaaacgtcttgccagcgcgctcgatcttatggttccgcttggcgaagtcctcgaacatcggcgtgccgtcttcgttgcgttcgaagctgaacgggcagggccgaccgactttcttttcgaaatgtttttccataaagagcagatcacgctggatcatatcgccgattgccgtcccaatgcgggtccaacgcccctgatacggaggctttcgcgttatgtctctcggatcgcctagcgccttatgataaagttcacgcgggcaggcattcgcagatgacggcgagaaatacggcttcttcggaaatactttcggagcatctgcgtaccatcggtgtatctgcgcgtccagtgcgttatcccccgtttccggaagcgagtgccattcgtttagatattcgatgagctcatccgcaatctgctgcgcatagccggccggctcgggcgccggcgctaattgggcgcgcagtgagtttgcggctgatcgtgcgtttgcgttcgtcaaactgccacccactctgttactacgacttcgcgtttttctacttcggtaatttcggccggatcgtcggctccgtaaatttcgctgtcatacgtccagtcagtccattcagatccggatctgccaatttctccgcgataatgtttatttccatcggtgaaaataacggttttactttggtacttgtgatcgtactcccatccgctttcctctacgactgtataggtcacatcgtcgatatcaattccgccctcaaacgccatatcttccagttgttcaatcgtcaatttaaccaattaaaccgcctccttatttttaaaccattcttctacgggcacgccttcgccccatttgcgcatgacttcgatatccgtaccgtttggcacaacgtctccccaacggtaagaattaagcatgatatcgcgaatttcttgcgcttctccccacgtaaaatcttccggaacttcgaaaatgagttcgtcatgtaccgttgaccacagcgcccagcccggtttgttagcgcaatattcgtgcgctttaatcatcgtgactttcgtttgaatagacgacgacccttgtacgcgagcatttgtcgcttgacgcaaagcgcgattaattcgtgaattatgtttccttgcgtcatcgtatttcggatcattccattttccgtacggaatgtttttgcgtgggagtttagcgtctggtagccggcgttttcgcgcattcagatcagcccaaacgtatccgttttttcgcacaaattcttcgttctcttttaaccacgccgacagcttcggcatacttccgaacaactcttccttaaactcggtcgcctcttttttacccacgcctaacatatccgcaagagaataatcactcattccgtacagtgtagctaaccatgcgaccttcattttctttcgctcttttgtgtcggaaccatcagcgttcttataaacttcctcgtacggtcgtttgtagaagttcgatgccatcgttgcgtatggatcgcgttcttctaaaaacgcattaatcagtactggttcgcccgacaggtgcgccacacaccggatttcctgcgctttaaaatcggcgcctactagcagctttccgggaggaggaccgaacatcggacgtgcttccggtggctgattctgcacgttaaacccttgctgcgttttatcctcttcgccctttccggagctgaatcggcccgtcacggttcccatcggattgaatcgcgaatgccaacgctcagttgttgggttttgctttgtcggcagcgtgtcgatatacgtaccactcaacttaacgatattcttgtactctaggagtttcgcaatgacatcgtagtcgtctttcaacggcttgagcgttttcttagcgtccatattcgggagctccttgccgattgcctttgaaagtgcgggccgcatctgatgagtcgagtttagatttatcggttcgtctccttcatggaatggcgtcaactccgcaactaattcctttcgcaactcctccgcacgcttatgcagcttttctccgtattctttcgcgaaatccaagtcaagaatatatccgttggcttctaaatcgacgattacatacaataacggaacttcaacggtttgataatattccaaaatcgtcgatattttcgccatgtgataacgctgaaattcgtacagcttccacgttaattcagtatccttcgctgcgtaaactagcgctagatctaacggtacttctttaaattgcgcattcctaccgaacaaagcatcgaaagtatctgccggtgtttttaaatatttaggtgctaagtctttgagcttgaacgaaccggctccgcctaatgtccgatcactctcgttttcgttcagaaggtgcatcgcggtcatcgtatcccaagcgacacctttcaaatcgaacccatgccgcctaagcatcgcaatatcgaatatcgcgttgtgtaaaaccttgccgaccgactcatcgttaaacacaggcgccagaccttcgagtacatattcgcgacttagttgctcgcaatcaacgtgctctaccggtatataaacgtgccagtcagcgtttggcaacgtcagtgaaagccctacgattacgtccgtataaacatctacgcctgtcgtctcggtatcaactgcgattattgtttcggtatttaaggcctcaattagcgctcggaaccgttcttcagtcgtaattaattcgtaattatccggcgtgttctcgaccatctgtcgcagggtttcttcgcgctgggattcttgcagcgtcttccataaccggagcgcctccgccttgctgaacgctttagggttaccggccttgttaacgcagtcagccggatcgcgcgccagcttgcccgcatccatggccgccttgacttccgttacccttttgcggtcggcatccgatagcttcatcgcgaatatcttgcgccagctttcctcgatcggctcggcggtcttggctttcgccttccgcttggccgtcgcctctactgcgtccgatttcgttgccgccggcttaagcgcgttcaagtttaaccgtaagccttccatccgtcgtcctccttcctcgcgaagtaattgcgggttacttttcgattgtatctgctacggtcaaaataccgaatgcaatgacagcgatagccgcgataagcaacattgtccaaggcgattcatctgcgccatgacccgctgagaatgcgattgatattccgagcgcatacgatagcgcgcgttcttttttccgattcataaatcgaccgcctccgtccatcttcgtttatagtccgcttcgttctccgcataccactccgaccagcaagacgtcccgcacgcataaacctcgaagagcgaatcgtaaattgcggatcgcccttcgtagaggttagcgttacgtgcggtgcagacggaggccggcttagcggtcaaagcgcgcctcgactggcgtaatgagttcgactttaagaaaatatccatgcactgtatccacgatggacccaccagatgcttgtttgaggacttcgataatatccccgtttgccacacgtccagcacactgattgtctactactctcgcgatatcacctttcttatactcgccaaccttgcgtccgatcttcgcccacttcgcttcttcgacttgctggcgttcgatctcggcgacttcctcttcggataaaatttcgagctgatccggcgctgcgaatccagaccctctaaaacagtcgccgccttcgattcgaatgagagtgactctccggtggttgtaggcgttatcggaaacctcgtaaatattaccgtccgtgaatccgctaagaggatagtctccgccgcctgaaagcaaccgcaccttatcgccttctttaaatttagcgcgtgctactgcgtctttagcttcggcaacttcttcgtcagtggcgcggacgagttcatcttcgtaaaaaattccggcttcgtttccgtttaatttttcgcaatggaaaggtgcgaaatctttgtcgtctctttttactagtacgatttcatcaatttccgcataatgagcgctttcgttcccgaccaccttcgcataatcaccgactttcaggcgttcagcttctgcggttacggcgcttactttgcggtagaatacgaagtcacggttactagcgtcatactcgtctccatcatcgtcagtgatccaaggatctctataactatcgaatcgaacaatttcgtaatattcctcatcggttaagtagtccggaggatcatcgaacttaacgtaatcgcccacattcgcctcatctgcgtcaatccgtacgtaccccgcttcacccttcaacgcagccacgtcggattttaacgattcgatctcgccttccgcctttgctacgcgttcttctacggacggattggtgctggcggcgacttttcggaaagcgataccgttaccattcttttggacggctgaagcgttccctctatacctcgttgggatttcgataccaccgctaggacgtttattcgccatgtaaaacgctccagtatcgccaccgattacgagatgtccttccgttaataggaatatgtcgccttcctgaacgggactatccgtcttcacatattccgcaccgccatactcaaccttcgtaatttcaccgttcaccatatcgagtgtcttaacgccttctaatttcgccaatcaaaccgcctccgcttcgttattaatatcttcgcgactgaacgccaaatccatccgtacccaacgcttgccttccttcgactgcggcccccaatattcggtcagctcgcgattctcgaacatccaaacggcgggcgccggacctgtgccgacctcgacgccgataaaataatcgacctcatcaagcgtataaggtgtgccgtcgttcttccgcgcctggacgatccgcttgccgccgcgcttttcacgtacgataatcgtcttcacctggaacgttttccactcgccgcttaacggacactttgcgctaatatcgaacgcttcttccgtttcggacgtactgaccgcctgccagccgctagccagcagcgcagcacgtgcgatcagttccgaatacttgccggtatcttctgctttatgcgccatataagcgcctccttttcgtttggttggtacgtgattagaacggtaattcttcgtcgctaggcttccaaggctcaggttcgttagagtctgccgagccgccgccctctaacggaggcaatacagatttcttaacaccgtctttcgcttcgtgtagcagcttaacaatgtcgctttcttcacgaaagtttgcgagctcttcgtacttgtaatcgataccgataaatgcttttgcttcttcgatgacttcgtcagggagatcgccggtttccaacgagtacgttttatctgcctgtttaaagtgaaccgcctgacctacgagtgtgtaatccggaaggatcttcttcgcaggtttctcggccttgtcatagtcgtcgattaaattgttcgcgtggaactcagcgatatcaattacgcgataggttttatatttcggatcgtagaccggaatcataaaaaacatcttacgctgcgctccggctttgcacgaaatgcattcatccttaccgggacggaaatactgctgtaattcttccgtacctactttatcgtgtggagagtgcaggcatgtgtgtttgcggaatttgtgatcataacctttccccgtgtattctttattttcgtgaacaaagtagatgtaccaatcgtcaggttgcgcgagaatgactaggctacgtccgtctttgttgatttctccatagcttccaacgcgaacatatcgcgtaacaccttccgggaattcactttcgccacttgacgctttatcccgttcctcttcacgtttctttaagatatctcgaatgctcattcgttttccccctacgtttttattaaggcttttcgccctcgcaaaatgccggtgtctgcgcccgaaacgccgccagcgcttggcagtagcgacgcgacacggattacctaacggccgccccgacattctccgaggacgcgacgcgcctatgatgcgtcgtcttcgccaatttgcgtccacatgccgaaaagtattaatccgataataacggcggcgatcggtcccacccacgaaagatcagacatacgccgcaactcctttcgccgcttttgtaagcctgcgttttaattcgaaggactcggcaggtaattcgtcaatacgcatctgaaccgcattgattcgcgcctggtacgccatcttcttcgcttttgatcgcgtccgtttaagctcggacttcagatgcgctatttcttcgttaagatccgcgatataattttcgttattttgaaccgcatcctctacgctttgtttcatcgtgtcgtacgcttcgttgataaatcggatcgccgtattcttttcgggaggatgaacggtcagtacataatcgctattcagcgcgaagagtataacgaccccttttccgccgtacatgcgcgcttccttgccgttagaatctacggtgattccgagatactttgcgtgctgaagctttttcgcaatccaattacgcgctacgtgtaaattcgtaatattgtaacgttccttcaggcgcttgcgtgcatggtgcgaaaacttgacctgaccggcggtaatcatccgacgcgcaccgccttaatcgatgtagccgggaaatagtcggccggatcttcgtcgtgcggccatgcgccttggtaaatgaaatcggttagtttgcgctcatctagcgcgattaacgtttggatttcgttaagattgggtaaatttgaagtagtcatagtacgttagcctccgttttaattgagattatcgtactaggtcgcggggatgcgttcgtaaagtgttcgcttgattccgttggcaacgaattgtattatagaggagtaacgaacgtcctcggacctagttacgtatagcgtgttatacagctagaaaagcgttaagttcgccgtgttgagaagcgtcgtaatttttcgctaaacctttgatcacacgttctacttttttgtagtgaacgcctaccttactgccgatcgaagcgtatgtaggtcgctcactcgaaagatgctcattaacgattgcagtcgttatggcatcggaatttactgttagggccttgataagttgcagcttatcttggtccgtttttatttctccatctaattgagaaatcaccttatcttctatatggacaacagcgccagattcgaatgttgcagcattctcttctgcggttgaatccattaatttatgtcgtttaacatatgttccattcttcccgcgaataatatctatagatgatttctttagttcgtagattatcgcgttttccgcgttttttattttttttgtatcgactgatgaagaccacttccaaagtttttcgtgtaaggcactaagtatgtcttcgcgaataacttgtctagttttagaaaaatcagataaaaccttagaaattaagtctcttgattcttcaaataggaggttgaagtcctcatcctgcctagttatttgataggcgttgattagctgtattaacttttcgtgtttcttcaactaaaatcccccctcatttattgatgcgtataaactttcctttttggacaccatttcataaaagaaataatattttctttcatgtccacatattagcatgtctaacattataattatctaaataggaacaatattttgatttagcaaacttgttcaggtatgtaaacaaaataaaaagcccacctaccgtgagatgggctttaaaacttatcctccgatcgcgttgattgctacttctttacctggatctgatacctggttactatacagcaaccctagagctaacacactcaccaatgttaaaacaactaataaagtcttcttcaaaaacaacatctccttttttcgatgaggttcccctcaagtttattgtcaggtttttgatgaaatcagtacattcgcctgcctccatcaaatcccttacaattatagatgcgtaatacaaattagaaccggacacgaaatcgcaaaactttttataaaggcttttccgatctcctgaaatcgcctcaaaatatccggtaaggtcagggtcgcccattttcccaacgcaatctagtgcatcttcataggaaacttttccttttctaaacccctcaacctttttcaaaacatcgggtgcactttcttcaactttctttgataagaggattctagcaaagttataattataaaccgcgtacccttctaatcgctcgttttttaattctttagctacttcaacactgtcttttaagtagctcaaacaaattgattcatctgtttgcaggtaagtcatgccaatgatgtacaaagcgtctgaattcactctcttgttaatattagcattgaggagaatatttgagtagcgtctagcttcttctaagttgtttgaaaaaaggtgtgcatatgctaaaatctcagatagcctgtacaaataacactcttttaaaaacagatgagatttatcattcaatccatttatttgaacttcgagttctgaagctttgtttattacatatgagaactgtcttttatgtagtaaagtgatgcaaccgtagatgtctacaagaattttaaggatcgggtcgttgaggtttgatagtttgtctagttcttcgtccattgaatcgaacttaacttttccgtgcatgtacttactgataaaagaatacaccttaacgtacttctcgataatattccgcttttcgcatttataagtctcgatatggtcatccagaagctcgatatctctagttatagcagcatactcaaaagtctttcttatacaatcggagctctcggttaattgagggcatacgtctctcataaaggatctataattttcaggatctgctaattgcgaaaggacaagaaggcttcttaatgtcagtttccgctttccagctctaaggtttcctacctgttttgtagacagttttaaatatgacgcgattaatgagtcatttaaatcatctctgtccgaaatacgatcaaatagaaagtttctaactttgtccatgttgttcaccccagttttaagtaaatgaatgacatttccaccacgttcaagtataattgaattatatctcatatgtttatatacgtaaacatattattgggaggatttttaaaaaaatgatcgatttttcccctttgatggagactttaaaagaaaaagaaatgaatctgagtgatttacgtcaggttatgagttcagctactcaagctaaaataaagaaaaatcataaagtgtctgattctaaaatgcgtttaggaactattgaaaaaatatgtttattattagacgttcccgtggaaagagtcattaggattgccaaggaataaatattggtaaatgttctttatataagttaaaatgttacggacacctttacgaatggaggtgtttattacgtttaaggtcggcaaatgccggatacccgaattatgcaaagatatcggaattgaacacgcacaactcgcagccaaggtcggactagataaatcgcgtatttccgattacgccagtcttcgcaatataccgaatatcgagctcgcctataatatcgctcgtgcactcggctgtagactcgaagacttatacgagtgggtagaggtatccggcgacgaaacggagggctagaacctccggccgacctgaagttcggaaattcccgaaccgactcgtaatacagtacgtacaccctccgcacgatcataaacgtttctcaacgcctctgcaccgcgctttaccaatagttcattagcgtctttcacctccgttatataaccgtgcgcaagccgcacctttccgtttaaataacgctcgatcgccgcacgtaatttatcgccagctttgtcgttatctgtaactaccgttaaatattcgataggagactgcgcaattatgtccgccttctgtaaattaaatgtgctgccgcctgttccgatcgccggtacgcccgcagaccgccacgccatagcgtcgatctctgcctcgcatatcaccgcgcttttaatccgctgcgcatatacgagatccattccgtaaactaaataccggataggcaagccgccttttacgtaccagaacgccttccccttcgttgccctatacttaacgtttgccagccggccgttaggaagccgccaagggatcgcgactgcgttaccggcaagtgatacgccagcctcttcttgtactgcggccgcaatgccccggcccgttagataagcgttaggccccggcgttgtgtcagcgaggaccgattccgctaaaggctccggcttcgtgacggcttttaatttcgggagccgcagcgccatacgtccgccttcagtcgccggtgcatacgtttccaataagtaatcgattgcgtcgtcttcggtttcgccgcgcaggaaagcgagcagtttaacgaacccaccccgcgcaaactcttcgtcataggcgcctgagtcgccccaatagccggcttttgccgacgctgtgtcttcgagatatacgtaaaagctcggagtccgatcgtatctgaatggactggcggccagcaggcgttcgtcgccccacgtcggccgggtccagtcgaattgttcgagttcataccgaatgtcgacgtctacagaacgtccacccaaatttaatatcggcaattcgagacacttcctttcgagacttgtaaattatattacgacattgttacgaaaattacagtcgcaatttgtcgaaactattcaaaaatttagatgtaattgttgacaatatcatccggtaaattccaaacgatctaaaactcgaacacgtccgcagccccggcgcccatttccggctgttttactacgccgatttgcggcaaatagatgatctctgcgacttccccttcgccgccgtcgcgccctttgttcaatccgatcaagccgcggccttctttcgcgttcgtatcaactgcgatcaataacgcagcatcttcgagcagggctttcgttttcttgacgtccttacgctgcggcagcttaagctcgcgcgctccgtcttccgtttctttctcgtcatcctcatctgcctgtgtgagcgcaaagatcgtcgttttcgtatgcccggccagacggcgcagtttttgcgaagtattagccgcgtctccgcctgccgtctttgacgtattggcttcgtagtcgaggtaataaaacggatctacaagcacgacgtcggctttcgtttcgataatgtccgattttagatcgcgcagggttcttgagccgaagtcttcgtcgtcgacagctcgcaccgtaatgtttcccggaatgatttcgttaagacgatcaaggaattccataaaacccgcctcgaactcgtcggatagtttgccctgacgtacgtcgcgagaattgaagccggcttccatattgacgccgttaagaatcgcagtcgtaactcccaggcttccggaaattgaaacgtataggcgcactaggacctcgtaccatcccatctccatcgaccatatcagaacgttcgcgccctgcatcgcacagttaacgacttcctccaacgcaatggccgatttaccacgccccgactttccgtaaataacgtagacgttagatgatacatagccgcccatagcccggttaataaagtcgaacttgctgcgccagatccggaaagactcgccggccttacggttttcatattccgctttaaacttgtcgatgtcccgtttgatatccgtcccgaccgaatttcgaacgtttgttctcattttaagactttcggcctgccccgtcaaccactcgaagaattttcccatatcaccgcttttttgcgcttcaataaatcgtttttcgagctgcggctcctgaacttggcgattggtttccggatcaatacggccgttcatcagctcgataaattcgcgctcggctgcccgatcctttaggtttttcgcaaggtaatcgtagctggcttcgatgttaaaatccggctggaagtccggcacctcattcgcaaccatctcggccgtcggcgcttggcctcggtgttgctcggcgtattgcatgacataccggaaggcttttcgttcgccttgcgttggtaggtcgttttcagcgatattaaaacgcaatagagcgttcgggtcgttcgcttcgatggctttcgatattagtaaagttccgtatttcattcgcccgcctcccgtcttaatttcgtcatcacaccgtcagccttcgttttatattccgcgtctccaaacgtttcgtaaaggcgcatgtaatcgttatattcgtctagcagtccgtcggttttcttcgcatcttccttcgctttctttttcgtcatctcactcgacaccttttcaagtccttttcctaaccccgcgacactttctatgcttggcaatttcggaaaatagtccgtaaagtgaaacgccgtgtttgtcggctccggatagttcgtcatgtcatacgtcatcaagaaatcttccgacgccgcctcccgacagaccaaacgcaggtcatcgctattggcttccagccattcaccgttaatcgcgtcggtcaagtcgtactcaacgtaatcaaaagcgccgtattcttcgtgctgtgtgacttcgcgccagcaatcaacgtagaaaatccgatctttgtatccgtctactgcgacaatatctccgattgcgaatttcggcttcattcgcacatctcccaacgtaatctatctaaaacaatgtcgtcgacctcttctccggattctgtctctccggtaggagtatatcttgatttatatacctcaccattctcgatcgcttcaccgaagtcgtggagtgttttaattggacgcgaataaacaatcagtctgtcaggaggagccggataggtgtgggtcggataaacaaatacctgacgtgaattcttatacgaaatgtactcgcacccattcgctccaaaccaaaatatatttaaatcaacattgtactctccaattatccctttactcatctacgtatcccccttttcgattcacctacgaattcaatctcgcgacagagatcgccaatacggtcggccagccgcttttctccgaacacggtcgccagcgatccaagcgcaacgttactcgtatagatggtcggtagctgattcgttactcttgcgttgattacagcgtgcaaatcgccgcgaaatccgtccgttgcatcacgcacccctatatcgtccaaaaccgcaaacggcgccgtcttagccgcttctaatgcgcgataataacgggcggccgccggctctgcaacggaatccggaacacgtggacggttgaattcgttatagtcgttctgccacgcgttcacatcgaggaaatacgccggcctctgcaacggatcgaggccacgccgcagggagccgctataatggacgcgcagccattcgttaagaagtgcggcggccgtcgtcgtctttccggtgcccggcgattcgcttacgaggtacagcgacttaatgcggtcggtcggcgcaaccggtccgctctgttcgaactgccgcgcaaaggatgccgcataagcctcggccgccttataagcttcggattggtcaccgcgcactggcgaattcttcagcgtgacgagccgatactccctcggaaggcctgccgcccctgatcgccctccttcgcctgatgcgccgtgcatcgcgataaaatgcgtacagtgccgcgtacatgcgtcggtcccggccgctttacatccgtcagcgagtacgcaagtattttcgttagtcatattcgcggacctccttccgatcaattcgttttcttatcgttctctcatgcttcgagcgcatccgcttatctgcaccctttacccggggttccggatacattgcgtcgtaagtccaatcgtacccgctatactttttaaacaccgttgttttcaagcgtctatggtacgtcactcacgcgcctcctttcgttaattctttcgcagggtaaactccgctctaaccttctgatcccacgagttacatatgaattttccgccagtagccgtgtaaccctttcgatttaaccactcgaccatagcttcgactatttccgcctgactcatcgtatattttacgttcattcgcacacctcttcgcgtgagtcatcgataatcgttaggtcagcgttatctataaaatcgtaacctccgccgacatatcggtatttaccatccgcaatttctctaatctttgcttcgtaactgtcatcgccgagttcgccttcacggcataactggtagtagtaatccgcgtacttgccgcgaacaacgtcgcccacacgaacctcagtcggctgcggggcgttcaagtattcgtctggcaccttcaatcccaacgcacgtcttagcgcaatcgcctttccgatgtgaacgttgaagcagtcgtccggcacggccctggcaataccacgaacatatacgagctcagttccagctcccttcaataaaactactactgtacgtttatctcgattaacaatgaattccgatttaacacagaacatttcaagtcggtaatcaaaaggcttaccaccgtgtgttctcccatatttcttcagggtttcaacgtccgccttcgcctgctcaacaatttcatcacggcagacttgggcgcttttctctggctgccataaacgttcctctagtgttgtacaaaccggagtcgttaccgtattctcatctccagatataacaacaacgtcttgattcgtttttgcatattgaactacgaatctataagaatatactccgccaataacgatatctccaaaacgagatttataaccgaaatatttatcgtccttcttttcaaatagcgtattcgcattattgattaccgtttgatttacgttttccattccgtcagcctcctcgtttttaacttcgctattgacgatgctttcgttcaagcgactttattattatatcttatcaatctcttgaagtcaacaactttttaaaatttcttttttcgtcagcgccttgtttagcggcaacgaataataatataccacctcacaaataatagtgcaatagttttttaaaaagaaaatcaaaaaagttttacaaacgacttgtttctaaaaaagcgccgtactgcgatatgcagaaacggcgctttcacttttattagcgatgtctcatttgagggaataataaaacgtctctgatagacggagcatttgttaacagcatgacgaggcggtcgatgccgatacccaatcctccggtcggcggcatgccgtattcaagagcttcaacgaagtcttcatccatcatatgcgcttcatcgtttccttcttctctttctttcaattgcgcttcaaagcgttctctctgatcgatagggtcattcagctccgtaaacgcgttagcgtgctcacggccgacgataaacagctcgaaacggtctgtaaaacgagggtcctcaggatttttcttagcgagaggagaaatctctacaggatgtccgtaaataaatgtcggctgaatgagtgtttcttcaattttttgttcgaagaattcattgatgatatggcccactgtcattgagtttgtgatctcgatgccatgttcttttgcatggcttcgcgcttcttcaacagtcatctcattccagaaatctacgcctgtcgcttctttgacggcatctaccatatggagtcgtttccattcaggtttcagatcaatctgctcttcgccgtactggattgtggtgcttcccagcacttcctgcgcaatatgtgcaacgaggttttccgtcaggctcataatatccttataatcggcgtacgcttcatacagctcaatcatcgtgaattcaggattgtggcgtgtagaaacaccttcattacggaacacgcggccgatttcgtagactttttctaatccgccgacgataaggcgtttcagatgcagctcaatcgcaatacgcatataaagaggcatatcgagcgcattatgatgcgtgatgaacgggcgtgcagacgctcctcccggtatgctgtgcatcgtaggtgtttcaacttctaagtatccatggtcatctaagtatcttctcatcgcttggatgattttgctgcgtgtgataaacgtttgtttgctgtcaggatttacgatgagatcaaggtagcgctgacggtaacgctgttctacatcttttaatccatgatatttatcaggaagaggacgcagtgcttttgtcagcagttcaaaagatgtcgctttgacagacagctcgcctacgtttgttttgaaaactttcccggtgatgccgataacgtctccgaggtctgaagatttaaagatttcatattgttcttcgccgacactgtcttttcttacgtagatttgaatttggccctctaagtcctgcaggtgcgcaaagccggcttttccttttccgcgctttgtcatcatacggcctgcaatggtaacttcgatcgctttttcttcaagttcttctttagaaagctcctgataggcgtcaatgatctgctgagattgatgtgttctctcgaaacgttcgccgaaaggatcaatgccgttttctctcagctggttcattttatcgcgtctgacttgcagctggtcgttcaattcctcatgattttgctcttcttgactcattggtatcactccgttacattttgatttcatgaaaaagcagaaaaactgccagcggtaagctggcagtgagcagcaatagagggtgtatattaacctacttttgcatcttgaagctcttttgcctctacttcagccgtaaatgcatctaaaagctgcacaaactcttcacgcgcctcacaatggttgattccgttgcggacctccgcattgcctctgacgcctttcagataccaggcagcgtgttttctcatttctctgactgccactttttcgccttttaacttaatcaggcggtctaagtgcagcttacatactgacattttttcacggactttcggttcgtcttttaactcaccggtttcaaggtactgaaccgtacggtagatcatccacgggttgccgagtgcggcacggccgatcatgacaccgtcaacaccggtttcctcgagcatgcgtttcgcgtcctgaggcgttttgacatcgccgtttccgatgacaggaatagagagggattgttttacttctttaatgatatcccagttcgcagtgccttcatacatttgcactcttgtgcggccgtgcagcgcaacggcttttccgccggcgcgttcaacagcctgggcgtttttcacggcataaatgtgatcttcatcccaacccattcgcattttcactgtgacgggtttatcaacagcatctactactgcggataccatttcataaattttgttcggatcgagaagccattttgcccccgcatcgcattttgtaatcttcggcacaggacatcccatgttaatatcaataatatcagctgtcgtattttgatcgacaaacttagccgcttctacaagggtttctttctctcctccgaaaatctgaaggctgagaggtttttctctctcctcgatgaagagcattcccattgttttcgcgttgttgtacagaatggctttgtcactgaccatttccgcacatacgagtcccgctccgaattctttaacagtaagacggaatgcggcattgcagactccggccatcggagcaagaactactctgtttttcaattcaatatcaccgattttaaacattaatcgacctcctttcgtgcattttgaggcggagccaattcctccgcgcttatatttaaagcatcagcagcatcacgaatgatcacagctgacggcaaacggtttccgcgttcaatctcgccgagaatggaaactgatatacctatcgcttttgcaaacccttcttgagtataccccttcagctttctgaatgcacgaattcgtctaccccagatttctgcttccatactcttacaccttcttggtttgtttcagcgcttatggtgatatgatccgcctgaggacaaatttcttttaacggcgcaaggacaaataagcgctcatacattctcggatgcggaacaatcagccgctctgtttcaatattttcacgattatacagcaaaatgtcaaggtctgccgttcgcggcccccagcggatctccctcgttcttcctaattcagcttcaatgctctgcgtcacatcaagaaggtcaaaaggtgataatgccgttttcacttcaaccgccatattgagaaactgatcctgatcctcatagccgacgggatccgtttcatatatggaggacacttttgacaccgtcacgccatcctgccggctgagcatggccactgcctggcgcaaatagtgttcacgatcgcccatattggagccgaggccgatatatgccgtgttgttcatgatttctttctcgtcatttctatggctactgatttataatggccgggaatcggcggatcaggcttaataacctttaccgtacattgctgcacaggctcaaatttcttaagaaccgtgtctgcgatccgttccgcaagcgtctcgaccaaattgacgggctcgccctcaacgatgccgcggcagacactgtaaagctccgcataattaatggtataagaaaggtcatccgtttgtcccgctttgctcaaatccagctcggcagtcaggtctactttgaaacgctgaccgagtttattttcttcttcgaacacgccgtgatatccgtaaaactccataccttctacatatactttatccatgatgtgcgcctcctttattcaacatagcatccatcatcttagtcattctcgcgatctgcttgacatcgtgcaccctcacaatgtcgcagcctttctggacgccaaggcataccgtcgctcccgtcccctcggcacgttcttcaggaggaaggtcaagcacacggccgatgaatctttttctcgatgtcgcgaggagcagcggataccctaacccgctgaacacttccagcttgttcatgacagccagattgtcctcatagcttttcgcgaagccgatccccggatccagaatcatgttttcatctgaaacgccggcttctgcggcaatttttacactttccatcaaatctgcgagcatatcaggaatcagatcgttatagtttctctccttgcgattatgcattaagataatcggaacactgtgtgcggcggctactgacgccatgtcaggatcacctttcgccccccagatgtcattaatgatggaggcccccgctttgaccgcttcgtctgctacggacgctttgtacgtatcaattgaaatcggaacgtccagttcgcttgtgatccgctctatggcggggattacacgtgacatttcctcatcagccgacacgagtgatgcgccgggccttgtcgattctccgccgatatctatgatgtgcgccccttcttcagccatcttcgccgcatggagaagcgctctttccgtactgtcgtatttaccgccgtcagagaaggagtctggcgttacatttaatatccccataatgagtgtcttctctttataggacagagcgcctttttttgtatgaatcagtttaggctgttcaattgtttgctgcgccattttgttcctcctcctatacattcattttgtttatttcccgctgatactgcgtccggagcaattgcaccgttttaccatccgctccgggaagcggcacttcctctattttagaaaacgggatgatttcaaggacggagtttgtcatccacgcttcatccgcttcaagcattgattgaaaacggaatcggccttcaatgacttctgtcccctgccgtttcaattcatcaatgacaaactgcctcgttacaccgtcgagaatgcctgtatccaaggatggcgtgaagaccttgtctccttttcgccaaaacacattggagacaatgccttccgcgacatctccttctttggtcaggaaaatcccttcaagattcggatcattgccgatttcctgtttagcgtacatgttgtttaaatagtgatgggattttaaccgaaaagatccttcaggcgtatttctccggacagagagaagcttgccttctttttgaacaggcagggcttccggattgagccggttgacgaaacaaaggacagtcggcttttcataagtctgggcagtaaatcccttatcgctgacgccggcggagacgttaagccggacacgcgcgctgccgtcctctatgtcattgaggagcaagaggctgtcaagcatatcaagcagctcctgtttgttcacctcatatgcaatctgcagatcccggagcgccctgttgagcctggcgacatgcgcatccggcagaaacggccggccgctgtaaagcctgaacgtctcgaacgcgccgatcccgtacagataaccatggtcaaaaggagaaagcgccgcttctttctcctctatatattgaccattcaaatatataatcacaccgtcacttccttcttgcggtgtgtctctataaagtttctgagcatctctttgccgaaggaggtcatgatggattccggatggaactgaacaccttcaatgggcagctcattatgacggattgccataatttctccttccttggtttgagcggataccgtaaagcagtccggcaatgtatccgctttgacaataagcgagtggtaccgagtggcgaccagcggattttgcaggccattaaaaattgtctgcccgtcatgcataatctctgacgttttgccgtgcatgagccgctccgctctgacgacatcgccgccgaatacttgtgcgatcgactgatgtccgagacatacgccgaaaataggaatgctgccggcaaaatgtttgatcgcttcgaggctgatccccgcttcatccggactgcacggcccaggtgaaatcatcaagaaatccggcgccagctcttctatctcttcaatcgtaatcccgtcattccgtctgacgatcagttcctcccccagctcacccaaatattgaaccaagttgtacgtaaatgaatcataattgtcaatcattaatatcatctctgctcacctcatctaattttttgtctcttcttcgctcagctctaatgcctttttcatcgcaaaagcttttttgaacgattccttgtattcatgcttcggaaccgagtcaatgaccactcctgcgccggactgcataaaagcatgtcctccggctgcatagatcgtccggattacaatgttaaactgcaaatctccgttaaatccaaaccagcctatagatccagtataaagccctcgtcttgtcggctcaagctcttctataatttccatcgttctcactttgggcgctcccgtgatggtgccgcccggaaaaaccgcatgaataatatctgtcgcgtcatatccgtcctgcagttctccctgtacatttgacacgatatgcatgacgtgggagtacttttcgatcgccataaactcgttcacccgcacggagccgtagcgcgatacgcgcccgagatcattgcgctcaagatcaacaagcatgacgtgttccgcacgttctttttcattgtgaattaattcatcagcaagcgccttgtcttcagcatcgtcttttcctcttgaacgcgtacccgcgatcggtctcgtttcaagcttcttccccttttttgttaccaatagctccggcgacccgcatatcacttgaaaacccggcgtctccagataggccatgtaaggagacggattaacgtttctcaaatgtttatacacttcatacggatgaacggataaggactgggattgcctgatggacaaattaacctgaaacacatcaccgctcgcaatatattgtttaatttgttctacagcctgtgaaaatccttcttcagtgaacggagcggcatacgatccgtctccgtcccggttcagcggtgaataaggctcgtcctccgtttggagggaacaccacatatcctctaagccggacagcttctcttccgcaagctccgcttcttccgattcggtatgagtaatgagccataacgcctcttcctcatggtcataaacggccacatcgtcaaaaacgagaaagtaaatatcaggtgtttccaaatcatctaaagacagcatcttaaaattctcaatatatcgggcgtagtcgtaactgataaagccaattgcgccgccttggaagtccgggaactcatcgtttgtttccgtcccaagcgcctcaaaccactcatgaaaggcccgcagcgggtcaccttctttaaacagcgtttccccttcatgcttgattgtcgtaattccgtctttccccttgacggacgcaatcggatctagaccggctatactgaatcttccccctctcgcgctttcgagcagaacatgccgttttctcgatttcgaaaggttttcatactgctgtaaaaatgcttgtttcgtaaaaggtattcttcttcctgccggtctgcgttgtgccatcttatcaatcctctgcttcgtttttctctagttttattttatagcaatcacactggtgaaaaaagtgaatttctcttccaacgatagaattcgaaacgttttttggattttcgatgcttcaggcacaaaaaaactcccggatacagccgggagccgtgtgtatgtctctattcaaactgatatagcggtgtgcttaagtaacgctctccgttactagggatgatcgcaagcactttcttgccttttcccagttttttcgcgatttccagcgccgcgtaaatggctgctccggaagaaataccgccgagaatcccttcttcttttgccgttttacgggcatattcaaatgcgtcctcgtttttaacgggaatgatctgatcataaatgtccgtgttcaatgtttcagggacaaaacccgcaccgataccctgaattttatgcggacccggttttccgccagaaagaactggagagtccgccggctctaccgcataaattttgatggatggatatgcttctttcagcacttcacccgctcccgtgatggttccgcccgtaccgataccggccacgaacgcgtcaagctggtcttctccaaactgttctacgatttctttccccgttgtttgacggtgaatttccgggtttgccgcattgttgaattgctgaggcacaaaatagccgtgttcctccgcaagttcttccgcctttttaatggcgcccttcattccttctgcgccgggagtcagtacaagctccgccccgtatgcgcgcagcagattgcgtcgctccatactcatcgtatcaggcataacgaggatcgctctgaggccttttgccgcagccaccatcgcaagaccgattcctgtatttccgcttgtcggttcaatgattgtgtcgccggcttttaatttcccttctttttcagccgcttcaatcatcgccactccgatacggtcttttacgctgctgcccggattcatgtattcaagcttcagatatacatctgcgctgttttcatccgtcaggcgattcaatttcacaataggagtattaccgattagttcagtaatagaatttgcaatacgaaccatattggacacctcaatttccgactaaatttattggtattataaatacaagttatcaatttcaaaattttttgtcaatcatttagttcttttttccccgtagaaccaagagacccccgcctctttccacagcgttttgaccgtcgccttatcacctaattgatccatcgcgatctggcgtctgatttggctcttcacttcattgtatgagaaagttctcgctttaagcttttctttcagctgaatgaccgcatatcctgaagaaactttaatcggttcagccgaccattcattttctttaaggtttttggcttctgtgatatatgccggcgggatattctcctggttttctgtcacaaagccgaggtctccgccatactgagacgtgtatctgtctgtggaacgctctgcggcgacggcttcaaagctggaaccgcctttcaaatcagccagaaccctgtccgcttcttctttgcttttaacgacgatatgccggattctgtaggaatcatcgaattgatacagttctttatttttattataaaatgattgcatttccttatccgaaatatcgatatccttcgtcagcagttcttcaagaagaatgttgtagcggatctggtctttccattctttttccgtaatatgactgtcttcataaaatgaattattcacagctttgattaaaagaaattctctctccagttcgctgtttgacactgtgagtttattctttttcgcaagttcttccactacttgtgtattaatcatgtcttccagagttgattttccgtactcatcttccatctttttcatccagtcttgcctcgtgatatgtttatcaccgattgtcgcgatggattcttcagatgatcccgcggcttgggattttgttaacttatacgcgactgccacgctgcatactaacagcgccgctacaataattgtcaaaagtgttctcggtttcaaaatctaccccatccctttaataaaatagaacaacccgctaaagagctagcgggttgtttcgtcacgaagctcttccagttcttcttttgtaaataaatatttctcattacaaaaatggcaaaccgcttcggcttttccgtcttcttctatcatatcttgtatttcttttttgcctagtcctaaaatagccgcttcgaatcggtcttttgaacaagaacagtgaaatttgaccggcatggtctcgagtacgtccggtttttgacccagtacttcttctaagatttcttccggtgtcaggcctttttgaattaatttagaaatcggttcgatttgagataattgcttttcgattgttgaaatggtttcttcatcggttcccgggagaagctggataatgaagccgcccgcagcgagaattgtgttatcagggtttacaagcacacctacaccgacggatgaagggacttgttcagaagaaactaggtagtatgtgaagtcgtcaccgagttcgcctgagacaatctctacttgtcccgtaaaatagtcacgcaagcccagatcttttacaacactaagggttccgtccgttcctaccgcccgtctgacatccagtttcccctgttcattgaggtcaaaatgaacgtgcggatttgatacgtaggctctgacttcaccctttgcgttcgcatctgcgacaatggcaccgatcgggccgccgccttctatcttgacggtcagcttatcttcacccttcagcatcgctccgaggatcagagaagctgtcatcgtccggccgattgcggctgatgccgtcggccatgtgtcatgccttctttgcgcttcatttaccatatctgtcgttctggctgcataagcccgtactttaccgtcatatgcaattgctttaattaaataatccatcgtttacctcctatacgtgacccacgcgatttcgctcataaatgatttcaagccctttcagagtgagaaacgggtcaacaatatcaatacagtctgattcgttcgcgatcaatgatgcaagtccgcctgtcgcaatgactttcggttcttgtttggcctgccatttcatccgcttcactatgccttcaacttgtccgacatagccgaaaaggatgccggactgcatggcgcttaccgtgtttttgccgatgatattatccggacgggcaatttcaattctcggaagcttggccgcacgggagtagagcgcttccgttgaaatcgtaatgccgggagcaatcgcgccgcccatatattgcttgttttcatcaatgtagcaatacgtcgtcgccgttccgaagtcaacgacaattaatgggccgccatactgctgaattgccgcaacggcgttgacgatcctgtctgcccccacttctttcggattgtcatattttatatttaaacctgttttcatccccgggccgacaacctgcggctcgatgtgaaagtattttgtgcacattctttctaaagagaacatgatcggcggcacaacggatgagatgataatcccttcaatttgttcaaacatgagtccggaatgttcaaataaggagcggagcagcatgccgaattcatcttccgttttgtgtctgctcgtttctatacgccaatgatattctaattccccatcatgatatacaccaatcacggtgttggtgttccccacatctataaccagtaacaacctctatcaccacttttgaatagtttctaatcataacattttcaacattctacaataccatacacgatctgcggctcttttgtaaacaaaacggaaccagtaaaaaaaccgccggtatatgccggcggttttcatatcagaatgcgaactattctttcggttcgtccttcttttcgtcttctgttttagacagaatgtttactttcacatcgtctttttgaagatggtcatctgagaaattgcgctctgggagttttccgtgatccacaagatgcttgatttgttccgcatctaatgtttccacatcaagcaatgtctgagcaatcaattcaagcttatcgcgattttcagtcaggattgttttcgcacgctcataacattctttaatgatgcgttgaatttcctgatcgatttcgtaagcgatctgatcactgtagttttgctcgttgttgaaatcccggcccaggaatacttgaccgccttgagattgaccgaactgaagcggtccgagtttttctgacataccgaactctgtcaccattcttctggcaatgttcgttgcccgctggaagtcattgtgagcccccgtgctgacttcgccgaagataatttcctcggcaacgcgtccgcccagaagaccgacaattttatcgagaagttcaggttttgtctggaagtaacggtcttctctcggaagcatgactgcgtatccgcctgcctgccccctcggaacgatcgttactttatgaaccatatcggcttcatccagcacaagtccgataacggtgtgaccgccttcgtggtacgccacgatattgcgttcttttttcgaaatgacgcggcttttcttcgcagggcccgcaatgacacggtccgttgcttcatcaatgtcgcgcatgtcaattttcttcttgttttgacgggcagcaacgagtgccgcttcgttaagaaggttttctaaatcggcgcctgagaaaccaggtgttcttgaagcaattgcttttaagttcaccgtctcatcaagcggtttgtttctcgcatggaccttcaatacggcttcacggccgatgacatccggacggtctaccgtaatctgacggtcaaaacgtcctggacggagcaatgcagggtccagaatgtccgcacggtttgtcgcagcgataataatgattccttcattcgcactgaaaccgtccatctctacaagcagctggttcagcgtctgttcgcgttcatcatgcccgccgccaagaccggcgccgcgctgacgtcccacagcgtcaatctcatcaataaagatcaggcagggcgcgttctttttcgcattttcgaataaatcacgaacacgggaagcaccgacaccgacaaacatttcaacgaagtcagatccgctgatgctgaagaaaggaacgcccgcttcaccggctgatgctctcgcaagcaatgtcttaccggttcccggaggtccgaccaacagtacgcctttaggaattctcgcgccaagctcggcaaatttgcgaggatctttcagaaactcaacaacctcaacaagctcctgcttctcctcatccgcgccggctacatctttaaacttcacgcgtttcttttcttccgtatacagcttcgctttgctctttccgaagttcatgacacggcttccgccgccctgagcctgattgagcaggaagaaaaacagaataaagatgatgacaaacggaatgatcgtcgttaagaacgtcacccacccgcttgtttcctgtgcgggatcaacttttacgtccgtctttttaattgcgtcaaatatctggtctgctccttttccttcaggaacatgtgttaaaaagtactggtctttgtcatattttttcagctgtccttttacctcataaacacctctgacaggctgaaccgatacgctgtcaactttcccttcatcgagattcttgataaacgtactgtacgacatattttctgttttcgggtttgaagtctggaagtaactcacaaccccgattactactaataaaataagtaaataaaaaatggtattacggaagacccgattcattccttacctcctcccacagtaagcacaactatgttcaatagtaccatagaaaatcattccaatacaaccgataaccatctcggaagcaggcagccgatcagctttcataaatcgccggttttaacactccgatgtaaggcagattgcgatagcgttcggcataatcaagtccgtaacccacaacaaacgcgtcaggaacttcaaagcctacgaagtctgctttaatgtccgcttttcttccgcttggtttatccaacagggtaacaatcttaattgatttcgctttacgatatcggaagagttctacgagatagctcaaggttaacccactgtcgataatatcttcaatgattaagatgtcccggccttctacagatgtatccaaatctttgatgattttgacttctccggaagaaaccgtggaatttccgtagcttgatacatccatgaagtccatttccaaatatgtatcaatatgctttataagatcagccataaaaggaagcgctccctttaatacaccgattgccaacggaaacgtgtcgctgtactcgcttgttaattgttctccaagctgttttactttctgctggatctcttcttctgaaatcagcactttttcgatatcttgtttcatgttaatgcttgccccctacacttttcatgctgtctatattgtaatacaatgcggtcactgtttggaatcacaagatcgtcaaagatggattttttcaagccaggcagccagataatttcaccgcttgcatccgttacaatcggccatacgtcccgatcacgcagaggcagtttatgatcaataaatatatcttttacctttttcgagccattcatccctttaagtttgatccggtcaccgatttttctcgtccggattgttaaaggaaattgcaccttatttctgcttgtcataaaaacagcattcccatttgtgatatgagggtcagcctgatcggccacctctatcataaagccgttgggcagaacagcagtctcgccttccgctccttgcagctgcagctcaaagggaaccttttcacattgccattgttcaaatgtaaacaaacatgtctgatatgatttgaccaccttcagccctttcggaaaatcaagcaccccagaagcgcttccgttttctgcccattcaagaaactgctgtatgtggcgggcggaaaacgacgatggaacgttttcataaagatagtttaatattagttgaactcctcttctttgtaaaggtatcggaagggcaagcaattgagaggagctgacttcaactgatgtgtcagacttgcttgtaataaccttattcattcgttctttcgttaatgactgcaagtattgttcgtcttctgtcagtgcttcactcactttttgaaacattttatgaacgtcaggtgattcttgttttaaaaaaggaagcacggtctttctgaatctgtttcttgtataatcgtcctttgtattgctctcatccgttctgtaggacagtctttcttgacggcagtattcaaggatttcatcctttgccgcatagaggaaaggcctgatcagcaaaccggaagcaaattcgcggacgggctgcattcccgcaagccctgccccgagcgtgcctttcgcaagcctcatgagcatggtctcaacttgatcatctccatgatgagccaacgctaaaaacttcgcttggtgctttgccatcagatctttgaaaaactgatatctgcaatcacgcgcggcagcctgcttgttcagcttattcttctttgcgtatgcagaaacatcaatctggaccgtttcgcagagaatgtgttccgcctcgcagtatgactgcacaaacttcatatcttcttcagattcagatcctctgaactgatggtcgacatgcgccgctatgataacggaggacttcccgaagtgcttattcagcatactgagaagcgccattgaatctgggcctccggagaccccggcaataatcgtttccccctccgcctgaagatgatatgttttgaaaaaatcttccacgcttttcacaatgtccccctcacgatgagcaggttttttaaagatatacatatcctatcactttcattccctccaagcaaagaagaagcatgagctcaggcgtccggccggcattagatgagaaaaaagacgatgtaagcgaaataaagggcgagaacgctgattaaaatgagtgttgtttcaaataaaccattgttttttgcgggtttttgtttaggtttataccgggtctgagaaacagtgccctgccgcggttttgcttgcggcggcttaggctttgcggcatccttccttttgctcccgatacactgccccgccgtcaggatatcatgcttcatggcttccgccgaaggatattggccgtttaaagcagaaaacagaaccttcttatacttattcaaaaacggatggccttcaatgatggaccgaagctgctctttcggcttgcctgtcttcttgcactctttcttctgaacacagtggatcatgatcatcgctacagcaaacaagtcataggatggttctgcttttcttgttccatacccccaatagcccctgtcgtaaaactccgtatactctttaattgcgcggccctgttttgtcgttccccctacatcaatgcagcgaatggcagccggaggtccggttacaatgaggttttccggcttgaggtcgccaaagacccatccttgctgatgaaggactgacagactggaaagaagctgaaccatcagcaccggaatccactctgttcccttactgctgatatattgcggaagaagcggcccttctatgtactccatcacgtaaaaagatacatttttattcagctgcggaataaacgcatcgtccgcatcaaaaaaagaaggccccatcgtttgcgaccgggcctttgaaaaggatttcaagacattcacttcagaggtaacagacatgctgtcgctgcttattttcaaagcgacatgtccgcctgatgcttctgccagatatacaataccgttagcccctttgccaagctgtttgagcaatctgtaggatttgccgttccatttgccctgaattgccgtccccggtgccagactacatgccaaactcgtcaaagcgtcgttcatcatctgccaacatgctccttcttgagcggattctctcaaactgctgtgtcgcttcccggatagcgggacccgtaggggtgattccgccggttgacagcttcgcaaagagtgcagaaagggattcaagcttcggcgtccaattcagcacaagctcaacttcctggcttttcccgggaaatatacacattgcaaattcattgtgtccggcccgggaatttaaactgatggaaagatcgatcagcgcttctttcaccgtcggcagttttggcgccatgctggcactcgtatcaaccagtacaagcacttgcagatgaaccgtttcgccgagctcatcaaccacttccatcacttcgccgcgtttttccggagaaagctcttccatttcaacgtttttccctaaaatttgtttaagctcttgattgacgacaccctgcagtgtctgggtcattgcttttttcgtcaccatttgaaccgtctgagacaattgagatgcatacacaacttggtggacgccgcctccggccatggcgatgccttcaacttccttcattgcctcttggtcaatcgcgttttcttccataattcctataacattcaccgtaatcccctgctccttggcgaaagccgccattgcgatcgggtcttcgccatgattggagcagccatctgtaatcagcagaacttgatttaaatgtcccttattcacatacattcctcccggtgatacgattagtcccatcttcgccagaaggaaagtgatttatacgaaaggtttaagaaatctccttattattttggaaaactgccggcacaggtatggaagcccatttcggcgtattatgatcaatccggacgacaacgaccgtcatgtcgtcttcgatttggccggcacgcgttctgatgacctcttccattaatatatcagcgatttcctgcgggtcttcggtttttagccctttcattttccgtttcatccacaggtcgtggttttcaacatgcttcggtccttcaaatataccgtcactcatcatgacaagcagatcacccgcttttaactgttcacttacgacttccacatcaaattcattgataatgccgatcggcagattgctggcctgcactttcatgacttgatctccccgcttaataaaactcggcgttgaaccgaccttcaagaatttgcagcttgcatcctgaaggtcgatgatagaaagatcaagagttgaatagatttcgtctgtcgtccgtaaagacagaatactgttgatggttttaatcgctatcttttcatcaataccggattcgagaattttttcaagcagtttaatcgtttcattactctcataatgagccctcgccccattgcccatgccgtcactgatcgcggccgcatactttctcgcgcccagttccatcatgctgtagctgtcgccggagacaagaccgccgccttttgccgcatgagccgcgcctgtcgatacccggtaagacttggtcgaaccgaacgcgacatggctgtagccatttggatgagtcgagtgctgttcgcttttgacaagtatctgctcctcaagaatgtcagacagcatcggggcgataattttctcactctcaccgtgccccccgctgaacgggattgtcatttcgatatcaatgttgccctgctccaagctgtatatctcgacatgctgaatctcgattccgaaatgctgaagcgcctctatcatttgttcttcctgtataaaatgctgctccctttcccgttttatttcccgagaaaagtccgccatgacctcagaaacccccaacagctgctcggcaacaagccttctgctgtcctggacttttcttttcagcgtcagatgggcgtgatggtgggcaagctcgtcttcaatcagctcttccacctgtctggatttggaacagtgctgctgaaactccttttttaatctgcggtttgaggcatattgtttttcttctgtttcatgcataacttgtttcattaaatcatatgttttatcaaagttttgaacccagcatttgcttttcttataacaggattggcaggaatgctcagtaattttgcttaaaaagagatccacttccccttcttcagcctgctcatcggaagacgtctgatgaaaggtggcaaagctctccgacaaggcatgaaacacattggagaactggtctactttctgggcagtgacatctctgattttcctcgcgtactgctgctgttcctgactgtgctcagcagtgcccggtatgtagcgcgccacctttttcgtaatcgattggggcgtaattaaaaacaaggcaacggcaattaacgattcgtaaagggtggtcattaatccggcggacccttccccatataatgaactcagcagtgagccgatcactaatccgactgcggcgccggctttcttgccttccttcagcagtccgccaagaagtccggaaaacgcaagcagactcatttgatagagattcccgatattcgcgagcccgagaatcagcccggtcacaacaccgacagtacagccgatacttgctccgccgacaaaggaaaaactcagcacgacatagcgggccaggatatgctcggcctgcattccttgaaatgaaacaccggcaagcccggttaaaacggatgcgatcaagatcataaaacagatgatttcttctatttttaatgattgtttcacttttttgatcgtgaagatcggcaagctttgcaaaaagatcagcgtcaaaataaaggccaagcccgcctcgacaacagccatcacataatcataggtggtaaaagcgccgctttcaaaataaacaaaaccgattctcgcggcagccatggagaaaaacaccacgatcggcagcatcttcacccggtcctgcataatatatgtaccgatttttgaaaatagagtgaagacggccaaagctgtcagaatcagcaaagagtgtttcggcgaaatggttaaagcgcccgcaagtaacgacagacaagcatagaaggctttatctcttctgatcaaaagcattgctccgaaaaacgggagcgcaaacggaagaacctcagataatatgaaagcccgtccaagtaaaaaaccgatcacgacataaatgaaacccttatagaaaaaaagtgaatgcgcttgatgaaccgcaagctttgcagccttttcaaaaaacgattgcagtttttccagagcttgtcccgccatcggcccgttcactcttctttccgctttttccattgctctcatcccccacctgttttattcgttgcttgtcattataaatgaaagcacagataggattttgtcaaaagaaggtaacgatttcaaagaactcttcgacgctttctcccttgttcccctttcctctcgtatttcctccgacatttctcaaaaagttgtctaaatatgaaaaaatcggcttctgtaaaagaagccgattcgcttggatgacccgtacgggattcgaacccgtgttaccgccgtgaaagggcggtgtcttaaccgcttgaccaacgggccaaatatatatggtagcggcggaggggatcgaacccccgacctcacgggtatgaaccgtacgctctagccagctgagctacaccgccatataagtgcttataagcacaagttatataatacaaaggtttcttcattccgtcaacaaaaattatgaagttttaattttctgactaagaggataaataaaaaaagcatccgcgggatagacggatgccccatgtatttatagaaagcagcaagttatcctcttcttgctccgcgccctccacgttttgattccgtgtttcgttttaaagatgataagcggtcttcgctatctttaagaaacttgttcattttctgttcaaaagattctttcggacggaaatcatttctaggtctggcttgcggacggtctttagcttttttaattgataaaccaattttcccgtctttttcaacgttgatgactttcacttcaacttgatcgccgacttttaaatgttcgttaatgtctttcacataattatcggctacctcactgatatgaacgagaccggttgagcctccaggcaattcaacaaatgctccgaaatttgtaatacctgttattttcccttgcaacttgctgccaacttcaatcgacataaaaaaagtgctcctccttaggcttataaaaagatcgtttgtttaattatacctaaataaaaatttaagtgtcaacaaggctacttgctcttcttttctacattaaagagaatctcaccatttcctgacataaacaagtctcttctggcaagctctgtgacgtaatcctcatcctttaatttggaaatttcatcttttaaatcagcctgtttcccgttcaattctttcacttgtttttccagctgagctttcttttcttcattcgcgctaagggaagaggtctgtgaccacagagaacccgctaagacaatagccgtcaacaacacaagggcgccgaatacaatcaaccgtctgaaaagccctttccgccttcttttcataagctgggattgccgctcaacctgctctttatagtcgttttgaatttcagttattgtacgttctctagatagattcaaatcagacggccctcctttcaccttttcaaaatacgtatcatggtcgatctgattgttatgattagtttcttgctcttttgtaaaaatcctgcacttttttgaaaatatcgtttgaaagtaagacgccacttttcaggaagaagtttcaatatttgtttcaacaggaagaacagcggatacagcaaaaatgttacgatcttaaaaagacatttcacaaaaaaggcaatcacccgataggagtataaagaaataaacgtgatcagcccgatgagcagcttaaatagcaggaccaccggacggaacagcacgtgctgaatgagcttttttgcgaattgataaagagacaccgcaagatgaatggccaatttcagcatttttatatacattcgtttaaacagactttggtacgtcgcaatacccagtaagacagccaagaaaatgtatatcctgagttctccttcattcacgttgagcagcacatagaaaaacagcaggccttgtacaatccaaaagagaatatcatgaacgaataacagccatctggccgttttggcgcggctgacaaacagcctgtatgtatcaagcgacgctccgagccaggcgcccataccggtcattgccagcatcgtataaaattgcgtcgtcagcgtcatttaaacaacttgctaaaaaaccctttagctttatccccttgctgctcgtctaaatatacaaggtcaaacaccctgccctttatagatacaatccctttttccacatcaaggtttttcatctgcagattctcacctctgacggaaagcattcccataaccgtttccagcaaaaactcttcgttatcaaaactttccacatgcttgacgcccgaaatgtctaaatgctttctccctttcatcgttacatcatgctgttccggaacagaagaagaacctttttgctcataatatgaattcatctattcagcccccatatcctcgatacttttagcattattactgcattgtatgaggcgggagctttgtttagaacaagcctattcgccgagtttttcttctttgacgattgtatacatacctgcggcttcttctttttttgttgtctcttttaattcatttacctttacggtgacaagcttttggccgaagcggaccgtcagttcatcaccggcttttacgtctgagctggctttcgcctgattcccgttaacggtgattctcccttgatcggcgacctctttcgccaatgtgcggcgcttaattaatctggatacttttaaaaacttatcaagtctcatattagaatctcctctccatttcttttgcttcatcccacaatttgtccatttcttcaagagacatcccggtcaattcaagtccctttgctgccgcttctttttcaatataagaaaagcgtctgcggaatttgtcatttgtcatggcgagcgcttcctcaggctcaattttatagtatcggccgatgttgaccaatgcaaataaaacatcgccgaattcagctttcaggcttacttcatctgcagattcagcagaagcctccgcagaaaattccttcagttcttcattcactttgtcccatatatcctgaacatcatcccagtcaaagccggtttttgcggcttttttctgaagcttggccgcttttgcaagagaaggcagtgttttcggtacggaatccagcagcgaagaggatgttgtttgtttttccgcctttttgatttcttcccagttggcgacgacatcatgttcatcctgaaccttaacatccttaaacacgtgcgggtgccgtctgaccatcttcgcactgatgtctctgatgacatcatcaattgagaaatatccctcgtcttctccgatctgagcgtgaagcataacctgaagcatgacgtccccgagttcttctatcatgtgatccgtgtcctcttcgtcaatggcctcgagcagttcgtagcattcctcaatcatatatttctttaatgactggtgtgtctgcttttgatcccacggacagccgttcggcccgcgaagctcacgaataattcttcggaatgcagaaaattcttggtaaaggagctcttcttttctaatcggcggaacatacacacttgttaagttatttatgccgacattgcggtcaagctcaaacaaaggcaccttggtgatcttttcttccttgcttcctgctgccgttacgatgaccacttcatagtcgtcaggcaatttctccatgagtgtcagcttgacctcagaggctgtcatctggtcataaacctggcaaatgatcaggtgatggcggagttcaagctcatccggcgtcattgtttgcgcatccgtaaattgaaatccttcaatcgggtcaattcgcagtgcgttgaaggtggcgtccagaaagctttgccccccggcggtgtgaacggctgcgtgttgttcttcccggcgttcaaataacagctgaacggttttctcggcgacaaacggatggccgggcactgcgtagacgacatcctcctgcttcgctttttcaaacagaatgtcagtgatctcttcatagaccgcttcaaactgatcatgtttttcataaatatcatcaaaataccggatgtccgctgcagcctcctgctctaattctggaatcaaagggtggtctttcgttcgtatatatagatgcttcgcctgagtcagcagcttatgtacgcccactgtcagctgatccatgtctccggcgccgaggccgacgaccgtaatgttacctgccatatttttctctcctcttattcaatttgcttaaagtactgccgaaaggaaggctgctcagctcttcgtccgtaaatattttcattcttatcatacaataaataaacaaaagccctccgatgactgacgcagataaactttcacctgcagctcccgccctgctgacgggtacacataactgccaaaccttcatatatgcgagcagaaaagagaccatcagcagactgcatccgcatagacgggcaaaaacgccgccgagattcgtcagccagcccttcgaccaaattctctgcagattcaggcacgcggctgcggcaaatgccaagacggtcgccagcgccgctcctgtaataccccagcccggaaccagccaaacattcagcacccatttcagcgcacctcccgccaagacggacacggcgggaaaaacggtatgtcccgctccttgaaggatcgcggctgccgtaagcgcaatcgaagcaaaaaagatagataagctgaatatttgtaaggtctgcgtcccctcgctgttttggaaaagcatgatattcaccggatctaaaatgcaaaaaagtccggccgccgcgccgatccctaccgcaaggcagagcttaacggcagatgtcgctttctcttttatgataaacggcttgttctcatgcaccgcttttgaaattgagggaaccagggacgcggcgatactgacggcgaacaccgttcccagctgaaggagcggctgtccgcggtcgtatatgcctttcagctgtttcgcagcatggctccctgtcccgtctgaaagcagggaatataagtttaaggcgtctacgagctgaatcaacagcatcaatacactgctgatacagatggtgactgaataaagcagcagctttttcacaatgacgcctgtttcgatatgcccgccgtccgtctttgtgtctttccgcttgtaccagaatacagccaatacacaaagggccgccaagcttccggcaagtgaccccgaggcagcgcccgcacccgccgcgtataatgagcggccgcttttcaaaagccaaaaggataaaccgagaagcaccgccacacgaagaagctgttccgtaatctgggataaggctgacggcatcatatcatgcacgccttggaaatacccccggaaaatcgctgtgaacggaaacaatacaaaagcgaacgcggcgacccgtatcagcatcacaaggcgggcgtcacccataaaaccggccaacgacgccgcaccggcatacatgagcgcaaacagaacaagtccggccgccgtgacataaaaggcggaaattttcattattttttgtttatgatcgctataatcgttcattaatttcgagatgattaccggaaatccggatgttgacagcattaccgcgatccctaaaaacggatacacctgctgataaatgtaaaatccgacgtcaccgacaatattctgaaaaggaaccctgtacacggcgcttaatatcttcgtcacgatccccgcaacgacgagcacaaaagcacctttccatgctgattgccgtttggcgccaactgaatcgttcatccaaaagctccttccagccgctagaaaattacgtctataaaacgagcttattatatcacaatcctaacggccggcggaccgatagagagcacatatgaaaaagaacagcactgtttaagagctgttctttccccgtttcttatttcaataatggtaataagacctactgttccatttgtctcgccaaaaaactggctgccgtttctaccgctttatgttctacttctccaagagcctgttccttagaaaaaatgaccacggcaccgataggatcgccattcgccacgataggagcaattgtataggagctcatatcttcttcaatgtcattaacaagctgtgcggacttcacatcgttttctaacactgagctgcgctgatccatcgttttttcgagcaaatcgctgatggatttgttcagaaattcttttttcgaactgcctgaaacggcaatatacacgtcacggtcgcaaatcaagacggaatggccgagactgtcatacaatgcatctgcatactctttcgcaaaatcgccaagctcactgataggagaatattttttcaatataacttctccgtcgcggtcaacgaatatttcaagcgggtctccttccctgattcgcagtgttctccgaatttctttaggaatgacgacccgtcctagatcatcaatacgacgtacgatacctgtagctttcatctctctggtgcctctctttcatgtgatgatatttaagggaaagtactaaagttctctactttatgtagcttccgccactcgcttgaaattagtatccgtcacatcaaatgtaatatacaccagagagtaacaatttttatgaagacgcgattgtttctttcttcacgccctgaaggcctttcagcatgccgagtacggtctccagccactcttccgttttgcggcctttcgtctgtactgagattttcagctttttcccttccattcccagtccgatttgccggccgtatttattgccgagttcgaacaatttctgtccgtcaatctgtgcactggcctcttccgaaatggtaaatctgactgcgtccttatcctgcttgatgagttcgacgcgttcatattttccgtacaccttcatctctgcaactgtaaacagccattcaacttctttcgggtaactgccgaacctgtcgatgatttcatcttgaagctcgtttttctcctcaattgtagtgattgatctgaagcgtttatacatatcgattttttgcttgccgtcttgtatatagttttcagggatatatgcgtcaagctcgatgtcgatttccgtctcaaactgttcgatttttggtgtatcgccttttcgctcttcaatcgcttccttgagcatctgcgagtacaggtcaaaaccgactgagtcgatgaaaccgtgctgctgggcgccgaggagattccccgctcccctgatcgtcaagtcacgcatggcaattttaaagcctgaaccaagctcggtaaattctttaatcgcctgcagccgtttttctgccacctcagtaagcactttgtctctgcgatacgtaaaataggcgtaagcgacgcggttggaacggccaacccgtcctctcagctgatacagctgagacagccccattttgtctccgtcaaacacgattaaggtattgacgtttggtatgtctacgcctgtctcaataatggtcgtgctgacaaggacgtctgattccccttccagaaaattaagcatgacgctttccaattcattttcggtcattttcccgtgggcgtacgccaccttcgcatcaggaacgagcatggaaatttcgtcagccttccgctcaatgtcatccacgcggttgtataagaaatatacttgccctccgcgcgccagttctctttcgatggcttctcttacaagcgccccgttgtattccacgacatacgtctggacaggaaaacggttttccggcggcgtttcaataacagataagtcccgcacaccgagcatggacatatgaagggtacgaggaatcggagtcgccgtcagagtcagcacatcaacattggctttgatctgtttgattttttccttatgtgtgacgccgaaccgctgctcttcgtcgattatgagcaagccgagatctttatagacgacatctttagataaaagcctgtgggttccgatcacgatatctaccgttccgtttttcaggcctttgatggtctcattggattcttttctcgttctgaaccggctgagaagaccgatgttaatcgggtagtcttggaaacgttccataatggtttcgtaatgctgctgtgcgagtatcgtcgtcggcacaagcagcgcgacctgcttcccgtcggcgatcgctttaaaggccgcacggatggctacctctgtcttaccgtaaccgacgtccccgcaaagcaagcggtccatcgggcgctctctttccatatcctttttaatttcctgaatggaacggagctggtcgtctgtttcctgataagggaaagcagcctcgaactgccgctgcatttcatgatcaggcgagaaagcatagcctttgcttgcttcgcgttccgcataaagcttaatcagatcatcggcgatgtcctgaacggaattttcgacttttttcttaacccgtttccattcactgccgcccagtttataaagcttcggttcttttccttcagagccgacgtacttctgcacctggtcgatttgctctaccgggacgtacagcttatcgctgccctgatagtgaatattgaggtaatctttatgaatgcccttgatttcaagtgtttcgatccccaaatacttaccgatcccgtgattgacgtggacgacatagtcaccgacttgaagctcggaatagcttttgatccgttcggcatttgtcagcttctgctttctcggcttcttcttgattcggtttttgaacagctcttcctctgtaatgacggccagcttcatcagcggcagttcaaaaccggattgcagttcgccttccatgacatagacctgtccttgcacaagcgctttggagctgtccgtttttgcggcttcaatttcgtaatcagccagcacggatgccaatctgtcggttctgtccttatttgcccctaaaaagacaacggtgaagtttgattttttaaagcgctccatttcaccggtaagcacattcatctgtccgtgaaaattctgcatctgccggcttgtcacattcacgatgttttgagggcttgtatgctgaacatgacgcaaaaataatgagaaataaattgccggacgccgcttttggcccataagctcctgaaagctgaaggataagttaatgtcatgcagaattttcccttcctccagcagacttgtcgtaaattcggcctcttctttttggagctgatcctccatttcatgaatgcggctgacctcgtctaacactaacaaggtgtctgacggggtataatctagcaaactagcaggtttttcgtaaaagtacgagagatacttcacaagttcctgatcagtctgtcccgttgataatcgttctttatcatgtgagatgttgatatgaagcatttctttttgtttgtcctgcttcagctttttcagactgtcggcaagccctttatcgagcctatccatcgcgcgggctttttcttccgcccggatgatcagttccttcgccggtccgatcgccaccgttttgagcgtctcaattgatctctggtcatcagagttaaagcttctgatggagtcgacctccgtatcaaacagctcaattcgcaccggatgctctgatgtcagcggataaatgtcgataattccgccgcgaatactgaattcaccgggtgcagaaaccatatcggaacgctcataccctacctcaacaaggcgggcagacagctgatccggttctatatcgtctccaagcgaaatgacgatttggctgcttttccacagctccttcggcggaagcattcttctcactgccgcaacgggcgccacaacgaccggggcttctccgtttgttaatctattaatgacatcgagccgctgagcccgcagttcaggactggctacagcaatttctgaagaaatcaattcatttacggggtatagaaaaacagattgatccccgagaagcgccgtcagatcttctgtcactttttgggcctgatataaattatgggtgataaagaaaatcggccttttcgtttcctgtgcaagggcggaggtaaaaacagaacgcgcggaacctgacagacccgcaagcagctgttccttcagcccctcatgtaaaccgttaacaatggatttaaaatcatcgctttctttaataaaggtttgaatattgtccatatgggcccctcctctctgttttctgcaagaacagaaaaacgctttggtctagaatctacaccaaagcttcttattgaataaatgtgttgtgttcatggtagtgcggattccgttccagcgcctcttggcagtcttcacaaattgtaagaacatggagatctccattgtctttatatgaaatcatatcgtttctttcctcatttgttaagtgctgaaatccaagtgactgtgtcggcaccgtcgtatattccaggctccctaccttaataccgcagtggcggcagaaataatgcaaagccatacattggacctcctgatgtgaaaaaatcatttttccctagtatggtctcccattatttatcttatacatttgcgttgaattcgttcataacttctaaaaatggtttcgttaaggaagcttcgcaggcttttaccgtttttgagacagcatcattgatatgcggcgcttcttctttcgtaaaagctcccagcacatagtcaacgactttcatcccgttggcgggacggccgattccgattctgacccggtcaaattcaggggttccaaggtgctgaataagtgatttaattccgttgtgtccgcctgcgctccccttcgtccggagtctgattttccccgtaggaagatcaaggtcatcgtatatgactttcaaatcttcatggtcggcatcataataatccaacagcggccgcaaacattctcctgataaattcatatatgtaagcggtttaacaagtagaactttttttccggaaacaaaacccattccgtaaagtccgttgaatttcgttttattcagttcaatattccattctttagaaagctcgtcaatggccataaagccgacattgtgtctcgtgttctcataggttttccccgggttacccagaccggcaatcacaagcatcgtaaatcctccctcaacatcgctgtaattcttctcattctagcacaaaagacgtaacctcgggcgggttacgtcttaaagcacttattgattttctccttcgggctcttcctcaggagatggttctgcatcttcttcgaatgcttcctgcttaggaggaaggatggaagccacgacttcttccggatcgttcgtaaatgtataattgccgtcagcagtcagatccgcgatggtcagcacatcattcatttccagtccggaaatatcaacatcgattgtctgagggatgtccttcggtttagccttaatcgaaagctcatgcagcggctgctggatgatacctccgtctttgactcctttcgcctctcccgtcagctgaatcggcacctcagcctccagctcttcactcatattcacgacttgaaaatcggcgtgcgtcaattcgtttttgagcgggtctgtctgaagctcagtcaccataaccgattgctgatttccgttgacatcaattgtgataatcgtgttttttccttcgtcccgcaatgttttaagcaattcgacactgtctaaagagacaggtgtattcgttgtttctttaccgtatataatccccggaacgtgtcctgaatgacggattttccgaagcgtcgaacgtttaaaatctgttctttcatttgcttttaaagttgccatattcagcaccatcctaattatcgttttatcgtcctattagaacaatacccacgatagccggaatttaaaccttaaactttcggtttagctgaataaatagctgacagattgtttctcgtgaacgcggataatcgcttcagccagaagcggtccgacagaaagctgtttaaagcgttcgatttttttctcctcaggaagcttaatgctgttcgtcacgacaagctccttgattttagagttattgatccgctcaacggcagggcctgacaatacagggtgcgtacagcatgcatacacttccgcagctccgttttcaaccagcgcgtttgcggcaagtgtgattgtgccggccgtatcaataatatcatcgatcagaatcgctgtttttccttccacgttaccgacgatgttcatcacttctacctcattcggtctaggacggcgtttgtcgataatcgcgatcggcgctttcagacggtccgcaagtttgcgggcgcgcgtcacaccgccgtggtcaggtgaaacaataacaatatctttcaagtctttaccttcaaaataatggcctaaaatcggaacacccattaagtggtcaatcggaatatcaaagaaaccttgaatttgcggcgcgtgtaaatcaagtgcgattacgcgtgtcgctcccgctgtttcaagcaggtttgcaaaaagttttgccgtaatcggttcacgtgatcttgcttttctgtcctggcgcgcataaccgtagtacgggatgacaatgttgattgttttcgcggaagcgcgctttaaagcgtcaaccataatcagcaattccatgatgtgctcgttgaccggcgcacttgtagactggatgatgtagcaatcacagccgcgaatactttcttctatgttgatctggacctctccgtcactaaatcttgtaacagagcactttcctaattgaactcctacattatccgcgatttcttttgcaagttctggatttgaattcaaagaaaaaatctttaaattcttatctccgtattcgttagacatggtaaacctccgattttaggattattttttatgaatgtttttcacataatcttctttatttacttgtcttgctctggcaatggcaagcgcttcgcccggcacatcttctgttacggttgaacccgcagcgacgtacgcgccttctcccactgtaacaggagctaccagattggagttgcagcctataaaagcgccgtcttcaattttggttaaatattttttcttcccgtcataattgaccgtgatggagccgcagcccagattcacgtccgtacctacttcggcatcaccgatatagcttaagtgagatgctttgcttcggtcgccgaattgtgttttcttgatttcaacaaagttgccgattttcacttcattgccgattgcagaatcgggtctgatgtgagcaaatggaccgatatttacatcattcccaactttgctccgattgacaacggattgtttaatcacagtacggctgccgattgagctgtcctctatctcagtgtgagggccgatgacacattcatcgccgatttcagcttgtccctttaacacagttccgggataaataactgtatcttgtccgatacgtgcgtcaggtgagatgtacgtattcatcggatcaattaaagtgactccgttttgcatatgacgtttgttgatacgctctttcatatacatttcagcctgagaaagagcgactctatcattcactccgagcgtctcttggaagttaccagtctggtaagcggcaacagtttcgccttcgtctttgaggatttcgataacatccggcaggtaatactcgccttgggcattttcattcgaaacctgttcgatgacacgaaaaagagcctcgttatcaaaacagtacgttcccgtgttgatttctttcacaagacgttcttgctccgaagcatccttatgctccacgattttttgaacggcgccgtcttcgctgcggataattcttccgtatccggcgggatcttcggcaacggccgttaaaaccgtggctttcgcacctttgtttgtatgttcattcagcatggcttccatcgtctccgccgtcagaagcggtgtatcgccgcaaataacgatcgtgacacccttctccccgtgaagaaatggttttgcctgcttgactgcatgagccgtaccgagctgttctgcttggattgcgtaatcgcttttctgtccgagctgcttcttcacatcttcggcgccgtgtcctacgatggtgacaagcttcgctaaagataatttcagagcttcgtctgcgacgtgctctaccataggctttccgcataccggatgaaggaccttataaagcttcgatttcattctcgttccttttccggcagctaaaatcactgcaaaccgcttatccatttaatggcctccaatatcccttttatccatagaaaaatatatcctaaatagctgttgatttcaagaagacatcaaaaagtgcaagaattttctatgtaatcgctttattactgaaaaatcagatttaaaaaaggactgccggaaaaggccttgtgtcagcctttatcagcagtccttacattttgttattttaagaagccccggcttcttcatattctaatgcttcagaatcacccaagcgatggtactcatttaaaacagcatcctggatcttgccccgcgtgctggaattaataggatgagcaatatcgcggaattctccatcaggggtgcgtttactcggcatcgcaacgaaaagaccattgtttccatcaatcacacgaatatcatgtacgacaaattcgtgatccagcgtgatggatgcaatcgctctcatgcgaccatcggtattcacgcggcgtaatcttacgtcagtaacttccacagtagttcaccaccttttccctatataaaagcattagtctaacaattccacgattctctttaaattcctgcacgtttcaaaaagttttttttgaaaatataggatatacatacacaattaggtgataaatcatattcgggaatcatatactgcataaaaaaagtgattccggagtccggaaccacttttctgagatttaagatttcaccagcgcaatgacttcaatttccacgagagcgtctttcggcagtctcgccacttccacacaagaccttgccggcttatgtacatcaaagtattgtccgtacacttcattcacttccgcaaactgctccatgtcagcaataaacaccgttgcttttacaaccgtttcgagagaagcacccgcttctttgaggacggcctttaaattgctgaacacctgatgcgtttgttctgtgatatcaccgtttaccatttctccttcagcagtaagaggaatctggcctgagctgtaaaacatgttatttacgatgatgccttgtgaatatggcccgatggctgccggcgcgtgtttcgtatggattgcttttgtcatttttctgtctccccattctttaaatgctgttctttaaaaaatcgcagaaaattgccgttttgaatctcaatcgttttgtctttcatgttgatggttgaaagggtaagcagcgacatgtattcatcgacaagccgttcattcactccctcagcttcaaccaagacgcctatacccgcgacgttcgcattaaactcatcaagcaggctgatcatgccgttaattgtgccgccggctttcataaagtcgtcaataatcaaaacgttcgaccccgtggccaaacttcttttcgcaagcgacattgtttgaatgcggttagacgaccctgatacataattgatgctcactgtagagccttccgtcactttattgtcttttcgtacgatgacaaccggaacgttcagataactggccgctgcgtaagcaagagggattccttttgtcgcaacggtcatcaccacatcaatctcccgctccgcaaaaacggaagcaaaaagcctgcctgcattagagaggacagaaggtttgcctaagatatccgttaaatatacataaccgcccggaaggatacgctcaggatttactaaagactgtcccagctcctgtataaacgcttctgcttcagcctgttttactttcggaatatatttgacgcctccggcagctcccggcactgtaagcagcgtcccaatgccttgctgttcgaaggtctgtttaataattgttaaatcttcactgattgatgactttgctgattgataccgttctgagaaaaacgttaacggtattaattcatgcggatgggttaacaaataatttgttaagtccaccaatctgccgctgcgacgaaacttcatgaacttacccccaaaatccgaataatttaaaaataatataacttaacatacggatttaatcaagagcattctgttcgccgatcatccgcaccgcgtacacctgatcacagaaacctcttaacccgttataaatccgctgcacctttgattcgtattgaaccaaaccgaatacagtcggtccgcttccgctcattaacaccgcgtcagcgccgaagcgtttcatttgatttttaatcatcgccacctcgggatgaaggttgagcgtaaccgattccaatacgtttcctaattgtccgcaaaccttttggaaacttttttcttcaattgcgtcaatcatcgcttgtacatccggatgccgaacctgctgcaagttcagccggcggtacacttcggcagtcgataccccaatcgtcggtttggcaagcacgacccagcaatgaggcggagcactgatatgcctgatcttctcaccgcgtcctgttgccagggcagttccgccgtatacacagaaggacacgtctgaaccgatttcagccccaagctccgcgagctcttcaacagaaagctttaaatcccagagtctgttcagccctctgagcgtggctgctgcatcgctgcttccgccggcaagccctgctgctacaggtatcacttttgtaatcataatagaaacgccttttttgacttggtaccgttctttgagcagtttggctgcctgataagccagattccgctgatcatcgggaacaaagcgattatgcgacgccactctgatcacgttttcgggcagttctgtcagttcaatccgatctgccaaatcaattgtcgtcatgatcatctccacttcatgataaccatccgggcgtttactcgttacatcgagggacagattgattttggccggcgctttttctaaaatacgcatagctttcacctacttctccatctaaacataagtatgaacattgtatcacatttggagacccggaggtacttatccgaaattggcgctgattttgacagccgatagaaaaaaaccggggaacggattgtcccccgggccactgcattatcggttattttggttctgagccgccatctgctgttcggcaatctcgattgcgcgctttaccatattcccggcatcgcgcgcccgaatgcctccccagccctcgtttttcaccgtatcgtaaaaaccaaggtcctttgccagctcatatttgaactcatctgacataactccacgacgtctgcccaaacgaaacaaccccttttatagaattgatcaccattcgtgcacgccacgataaaacatgtgacatctatagcttccgtttaatcggctgaaactttcgagggaataattagaagagctttagaaggcaaaacaaaaagcagtaaacaaaaggttcactgcccattaaaatgctactgagcttgccgcatcatcattgaatgtcaattcaacagtctcagtaagaatatcagcataactgtatgaaactctttcaaacgagttctcgtcttgatctagttgtatcacaaaaacagaagggtacgtctcagctaaaatgcccgaacgctcaatcgtttttcggcggccgccgtttgcttttaacgtaagccgtttacctaaattcccatcaagcgatctttttatatcggacaacgtcttcgccattgcatccacctcactacatttattgtacaacaagagcccaattttgtcaaataaaatttaaattatatcaacgttatcaagtcattgtcaacaaaattattttgacaaaattctattgatttctacgttatttttcgcaagttccggtaatttatgtatcaatatgtaaaataattaacccgcatagcgaaatttatgcgggtttttcactcatccatttgatttatacggcataccgacacgcaacacacctttcgtttcaattcctcccagccctttctctcgtgtcagagtgtttctcaggacatcccacacattgatccgctccataaacggagtgaagctgatttttgcgacaatatagaccgggtcaagcgcatggatgttgacgcgtgacggtgaacttgcaaaattcgcacccgctctgattaaagactcgaaatgggattggcaggcacccgcgaatatcaccagctggtccaagtgagggactttccgcctcgctcgttgaacggtttcgacaaaatgtttggaatgcctgtaggcgcttaaatcgttcacgcctcccttatgcttggaataagcatcgtgaccggtgatgactaaaatatccggccggtatttgtcgagcagctcctctattgaggccgccatttttttctcatggcaatgaatcccgtatacaggcacaccgattttttcgtaaaagttcaggcactttttcaaataagcctcatcgccgtccagatgcaataccttgccgggcatatgaaagtagtgctcctgatgctgatattgatttgtcgcgtaatattcctgtttttcccgaagcagcttataatcctggcggagcagctcgagagattcattcatcctgctttcatctttctgctttctcacggcctgttcgtcttttcttacaggctctaaatcagaaaaatcagcatccgcaatcaatctgacttcgtcaccatgcaggatggcaattgaatttcctttgcttgtttgctctatgccgataatgcgaaataaaacatccatttgataggatttcctggctaccatatctcctatttgaaattgcacgttacccactccacaaatagactaagcctcatcatgaaagaagccttatcaaatgcacctctttccgctgcggcgcttgatgtttcaagcttttcttgcagttgaatgaataaggttcttctctagcctatgtagcggcagtccaagtggtgacgcaaaacaaaaagcccttcttagaaaagggctttatacaatccgttggacaggagcgcgaattcttctatagacagggattcaccgcgccgctttccgtcaatattcgtttcttgaaggacttcttcaatttgaggttttttctcttttccgcccgggagattgttcacaaggttgttcagcaaagttttccggcgctgagcgaagcttgctttaatcagctggaagaaaaatgattcattgtcgacgtccaccgccgggccgtcacgcagcaaaagccggatgaccgcggaatcgacattaggctgaggcacaaacaccgttttcggcacggtcatgacggtcttggcctccgtgtagaactgaaccgcaatggaaagagatccatactccttagaggaaggatctgcggccatccgctcagcgacctctttttgcagcatcacgacaattccttttaacggaagatgttcttccaaaagcttcatgatgatcggtgtcgtcacataatacgggagattcgccgtcaccataatttcatcacagtcctgaaactgctcttcaataactgacttaacgtctgctttcagcacatcatgatgaatgatcgttacattgtcataaggagacagcgtgtcattgagaatgggcaggaggcgctgatcaatttcaaacgcgacgacctttttcgcccgtttggcaagctgctctgtcagcgcgccgattccgggcccgatttcaatcacaccggtccgatccgttatttctgcatggtccacaatcctgtccaatatgtttgtgtcaattaagaaattctgtccaagactctttttaaaagagaaaccgtactttttcagaatttccttcgttctgataggtgtcgcgatatctttattgttcatcctgttcctcctgcatcatagcatcgagcgcatcaataaaatcacttcttttgatttgaaacatttgcagccgtttttgaagctgtttgccgtttgtatatccgattttcagcaggtcgcccaaacgttcgcggcgtcttttagcagccggcccgccgatcagaccggcctgtattaaatcttcagctgaaatctcactcggctttgcctccatctcttcatgcacattttccagacatgctctgatgctttcaatggatgcgtgctcaacgcctattccgcgcttgtttttcggtttggcaagatgtttgggcagaaatgcgtgtttacagccgggcactgcttcagaaatggttttccggatcttttccccgggaaaatccgggtccgtcagcacgatgacccctctcgtttcctgcgccagccgaatctgcctgatgacttcgtctccgatcgctgaaccgttcgtctcgatcgtgtccgcatcaacggcaagttttatgcgcgcggtgtcatcgcgtccctcgactacaataatttctttaattttcattacttcctccaaaaaaactttttatatccaaaacgaaacctttgcttacatgtcacgtctaatatactgaaaatacactttacctattataacgaaaaaaacagagggcgcaaaaccctctgaatgaatcggaattaatttaagatttttattttgacctgttttttcccccagcggtaagccgaagatttttcagggaaaaagacatcaatccgtcttcctttaatggccgagcctgtgtcagcggccacagcgtccccatatccgtctacgtggactcttgtgccgagcggaatgacgcttgggtctaccgcaatgactttggcattcggattacttgtcaggttaacgcctgtagccgtatggccggaacagccgctgcagcttgcggtatatgccgtggaagacacggtaatcactttaccggaagatccggcttcgcccgaagatgcctttgcactgagctgctcaatcttgggactgtgccgctttgtgccgaccgcaatgatctggtctttgcttttttcagatgtttcttctttaacaagctttctcgatacttcttttccattttctttaacaacatgaaaatgctttttaagcttgccttcttttcctttttgaacgatcttttcttccccgctgtcgagtgacgcatcttctttttctttcacttgatacgctattttttcctcaactacatcggtgactttttcgatacgagtgatttgtatgccggcttgatcttttgtgagcttttcgtgtaatgccggttttactttatcttcgtctttcatgtccatcttatgctgcgttaaaaagtcagcgaccgtagtcgaagtcgtccatattttctttttctttcccgcatcatttacagtgacctgaaaagccggatctaccgtgactttcatgccgtttgtcactttcgtatctgctgccggatctattttatcgtgctgattcacaggtgtatgctgttcgtctagaaatgcgccgactgtttttgccgttgaccataaagtcttttcttctccgcctcttgtcacgcggatctgctttgcagcttcatacacgacattcatgttgtctgccaatgctgtctgcttagagggggtaatccggtcttcatttctcgtctttatatgtaaatcttccagaagttccccaactgtttttgcatgagtgcgtatttgctttttcttgccgttgatggaaacagagactgattgttttgagagctcatgcgccccgtatgcagtcccggttcctcccagcagaataatagctgcaataagaataaccttgcttttaccaagctttacggaaaacagttttttcattttttgtgtgatgaaaaacgcctccttctcctcggagagattatatagagtatctaaaatgctgtcaaccctcccatctcgaagatcaaaaaccttcagcgtatccctcattatgcaaaaacaaagcaaaaaaaggaagaaagagatatcgacaacctatcttatgagaagaaggaagcttgtagaactgtttgatatatcctctgaatcggacaagcctttacacgttacgacagcgcattctgtcagttcatgcggaaaagtctttttgcattttcagttgtaatcgaagcaatttcttcatacgtcagtccttttaattcagcgagctgttccgcaacatatttcacgtagcttggctcattccgtttgccgcggaaaggatgcggtgtcaggaaagggcagtccgtttcaatcagcaagcggtcattcggaatttcctttgccacttcttttggtttcttcgcatttttgaaggtgaccggtccgccgaatgagatatagaaattcatatccatacactgccgcgcaacctccgcgctgcccgtaaagcagtgcataataccgccgacttcttcagccccctcttctttcaaaatcgtgacaacatcttccgttgcatcgcgattgtgaatgatgattggaaggttcacttccttggcgagcgcgatttgttttcggaacacctctttttgaatatcctttggtgatttgtcccagtgataatcaaggcccatttctccgattgccacgactttttcgtgagaggacagttccttaatccacgttaaatcttcttctgtcatgtcgattgcatctaccggatgccagccgatcgcagcgtatataaagtgatattcctcaatcagttccatcgcccgcgtgatagtgggtttgtcgaatccgacaacgacaattcgttcaaccttttcagcctttgcacgagcaatgacttcctcaagatctgtgtcgaattgctcggcgtttaagtgcgcatgtgtatcaaaaagcatcataaaaactcctttcttgttgaaaaacaaaaggtgttcgacggaatgttacacgtgaaacaccttttgccccttattatttaattctagtgcctttcggtaatgactgatcgacagctacaaccttgaggacaccgtcagattctcctgcgaggatcatcccttgagaaagctcgcctctcagttttaccggttttaagttcgttacacaaatgattttcattcccacaagctgatccggtgtgtaatgtttcgcgatacctgatacaacttggcgctgttcaaagcccaaatcaatttgcagtttcaacagacgatccgctttttttaccggttctgcggacaagacttctgcaacgcgaagttctgtatccatgaattgatcaaacgtaatttcaggaaggcgctcaacttcttgcggctcttccgccttttcttctttcacaggagcagtcccctgcattttttgcttgatgtaagctacttcctcttcagcttcaagacgagggaaaagcggttccccttttttcacttttgtgctctttaattggccaaatgtctgaatgctgtcccaagctttaagagactgatcctcaactccgagctgggcaaacattttttcaggtgtttgcgtcaagaaaggctgaagaagtacagccgaaatacgcaatgattcagctaaatgatacatgactgagcgtaattctttttctttttccggatcttttgccagcacccacggagcagtttcatcaatatatttgttcgtacggctgatcaattgccatagcgttgataaagctactgaaaactccatgttttccattgccttttcataagcttgaaccgtttctccggctacagaagaaagctcttgatcaaaatcggtcacatttccttcatatgaaccaatctcaccgtcaaaatatttttggatcatggcgactgtccgattcagaagatttcctaagtcgtttgccaagtcataattaattcgttctacgaaaccttccggcgtaaagacaccgtctgaaccgaacggcacttcgcgaagcaggtaataacgaagctcatccaagccgtaacgttcaatcaatgttaccggatcaacaacgtttccttttgatttcgacatttttccgtctttcatcaataaccagccatgcgcgaaaacttgcttaggcaacgggagatcaagcgccatcagcataatcggccagtagatggtgtggaaacggacaatttccttaccgaccaggtgaacgtcagccggccagtactttttgtaaagctcgtcattttccgtatcgtaaccgagcgctgtaatatagttgaataatgcgtcaatccatacatacacgacatgcttcggatttcccggcacttttacgccccagtcaaacgtcgttctggaaacggccaaatcttcaagacccggtttaatgaagttattaatcatttcatttttgcgtgattccggctggataaatgaagggttttcttcataaaacttcagcaggcggtctgcatatttgctcatgcggaagaagtatgattcctctttgattaattcgacagggtggccgctgtccgggctttttccgccgacaacctcgcccttctcattacgttccacatccaccagctgtgtttcagtatagaatgtttcgtcaggaatgctgtaccagccctcatactcatccagataaatatcaccattatcaagaagcttttgaaacactttctcaatgatttctttgtgccggctttccgtagtccggatgaaatcatcgtgagaaatgtcgagctgcttccacaatttttggatttcagcaacagcgcggtctacatacgcttgaggcgtgatattctcttcctccgctttctgctggattttttgtccgtgttcatccgttccggttaagtagcgaacgtcaaatccctttaatcttttgtaacgcgccattgcatcgccggccacggtagtataagcatggccgatatgtaattttccgctcggataatatatcggggtcgtaatataaaaagtattattctcttgcggcatgttgcaacctcccattcagaatgtcgaaaagctcacgcccaaaggacgagagcggttttatttgatatacaatattgatatttgtcctctatctatgataccatcttagcctttaagatcaaggatatatacgtactgcgcgtaaaagagtaaataaaattaaaaatttttattgaaattaaataaagtcttaacatatcgaattttgtcgtatataatctactaatataaaacatcttggttcgaaagtcttgatttaaaaggattttccataggataataggttcgaaaaagcagtcaaaaagcctgttatttcaggatttccaaggctttacttactataagaactaattcttacaaacaatagtaaacaaaatgattgacgattattggaaaccttgttatgctaggaatgtaaggaattttgtcgaataatgacgaagaaaaatataaactacaaataattatctctcgggaggagactgttaatgaaatctactggtatcgtacgtaaagttgatgaacttggacgcgtagttatccctatcgaacttcgccgtacactgggcatcgcagaaaaagacgctcttgaaatttatgttgatgatgaaaaaatcatccttaaaaaatataaaccaaacatgacttgccaagtaactggtgaagtctctgatgataaccttaaacttgccggcggcaaattggtactcagcaaagaaggcgctgagcaaatcatctctgaaattcaaaaccagcttcaaaaccaaaaataagttatttcatacaaaaaccgttcttgttgtgacgcaagaacggttttttttatgattgaatgtgataagcgtcatagatctcgcgtttcggtacgtcccgatctaccgctgtttgttttatggcctgtttggaagaagccccttcatttatgtaatgttccacatgctctttttcagaaagctccatccaccagggtttgtcgtcttcatccggttcagcggcttgattgccttcgacaacgagacagaactcaccgcggatttggtcttcatttgcccattcaattacttcggcgatcgttcctctgatgaattcctcgtactttttcgttaattccctcgtgacggcgatgtttcgatttcccaaaacggcatgcattgctgttaatgtttcttttaacctgtgcggcgcttcgtaaaatatcatcgtttcctgccgttttttcaggatttcgagttccttcttcttttcttttttctgtctgtttaagaatccatagaagaaaaacggctgcggggtgatacctgatgcggtcagcgcggttaacgccgcatttgctcccggaagcggaacgacatatccgccgatttgggtgaaatctcttacaatctcagcccccgggtcggaaattgtcggcataccggcgtcactgaccagtgccacattctttcctgttttcagccattcaatgattttatggccgctgctttctttattatgttcatgatagctggtgagagatgtttctatgtcatagacgtgacacagctttttcgtctgtctcgtatcttcggcagcgatgacatcgaccgatttcagcgtctccactgcacgaaaggtcatgtcctccaagttgccgatcggtgtaggaacaagataaagaattcccatttcggattttccgttaaaactcatctggcgacttaacatatacagcctccttgctgcttcgtttttcttctatatattgttcttttttctttcgggtcagctgcttaaaacgatattccgcctgcatcgcttcccgttttgtttcaaatgattccgcatggcataacgaaaccggccttctcgcccttgtgtactttgcgccctttccctcattgtgggtcttcagccgtttttgcagatcatttgtataaccggcatacagactgttgtcattgcacagcagcacataaaagaaatgactattcgtctccatataaaatggtgcggatctctttcgtatattcattttgttcattatatacaaacagcggaggaagaattttgagatcagggcggccgcctttaatgccttcaaccaaaatggtattcgcttctttaccttgtttcggataaataaactgcacccgtttcggttctattcggtatgctttcattaattcaaagatttccaaaagccttcccggccgatgaacgagggccgcttttccgccttgtttcagcagtttgctgctgacggaaatcacatcttcaagcgtgcaaagaatttcgtgccttgcgattctgagatgttcgttcagattctgctcagcctctttcggcgttttaaaataaggcgggttgcaagtgacaacgtcatatttattatgtccgagtctatccggcatatttttcagatcatcatgaatgaggctgatctgaccgcccagaccgttgtattcgacacttcggagcgccatatcatacaaacgctcctgaatttcaacccctgtgatatccgcttttgaccttgtgctgagcaaaagcggcacaatcccatttcccgtacataaatcaacgatgttgcccttttgaatcggaacgtatgcaaactttgacagcagcacggcatctagcgaaaaagcgaaaaccgtcgggctctgtacaattttcatatcctctgctaataagtaatccaatctttcatcatcacgtaatgaaaccataatcttattcctttcagcactctttgaaaaaggcttccgacatcagcggaagccttttccttattttttatttaagaaggacagacaaaaaaggcaatctcccttgcggacgctcccataatggacgttgcaaatatgaaagccttcttgatacagccgggccagattatcgtacccttctcctatatcactctgctctgccttctgtgtttttgtttctttctgatcggccttgaatttctcaatttgctctgtcgtgtcatcaagccgcttccgcaaatgcttattttcaagctgcagatggtgattctcttcaatcatttcgccgatatgctgctttaagtcacccagctgacggtacagcgaaccgatttgttcctccaggtttatgacagtatcaattaactcttttttatccaaggttccacacctcgttaatctgtggtttgtgcggatacgacgccctcttccaagagctcttcccaagtatattctatcactttttcacgattcttcagttccacctgaagcacccgttccagaatattaagaccgacaacctttgcggggccgtttgccgttgtaatcatttcgcctaaatccggtagctgttctttcgccgtctcatactcatcattttcgtacttcaaacagcacatcaaacggccgcacagacccgaaattttcgttgggttcaacgataaattttggtccttcgccattttgatggacaccggttcaaaatcaccgaggaacgtggagcagcaaagcattctcccgcacgggccgataccgccgagcattttcgcttcgtctctcacaccgatttgacgcaattcgattcttgttttaaagatagaagccaagtctttgaccaattccctgaaatcaacccgtccgtcggctgtgaagtaaaaaatgactttattgcggtcaaacgtaaactcaacatcaaccagtttcatatctaagccgtgatcagccacttttttctgacagatttcaaaagcggacagggcctcttgtttgttttcttctacaatgagaagatcgcgttcatcagcaacgcgaatgacttttcgaagcggaagcacaacatcatgctcgtccacttgtttatttgcgatgacaacctgtccgtattcgacacctcttacggtttcaacaatgacgcagctgtcctgttctatatcaaatccgttcggatcaaaataataaatttttcccgcttttttaaagcggacgcctattacgttgtacaagcttatccctcctgcaacgttaacaccaagtgctccattaatccctgcgcattcacattggaatgaagccgtttttttgcttctaaaacagcgagaatttggttcgtaacgctttgttgtgtaaattgcagcgcatgctgttttattgattggaataagtcttgataaatcagtttatcttcatttccaatttggatggataatacatcacggtatatcaataagagcatatcaagacccatttcttgatgggttttttctttgaaaaagggcacccactgatcctgaatgaagaaaaaggcatgtcctttccgctgatgtaagacttcatacaattttatcactttcgctctggactctgcaaactcatcatttcgacttaattcgactgcttccgcaatgttatttgtcatatttgctaagagtctggccatgtgagggcttacttcctgctccatcagtctctcttctatcgctttcggctgaagcggctgaaacggaagaacctgacatctcgaaacgatggtatccagtattctgtggagctgctcagtaatgagaattgcgatggtgtcttgactcggctcctctaaaaatttcagcagactgtttgccgcatttgtcgtcatttgatccgcatgggatataatgtacagttttttatgcgattccagtccggttttagaaaactcctcctgcagcgattggatctgagcctttttaattgatagtccgtcgggctgaaccacgtgcaggtcaggatggtttccggatgcaatacgcttgcagttccggcactccccgcatggctcagtcccggcttcaaggcaaaaaaagctttttgcgagaagcagtgcggcatccaatttgcccgtaccttttttgccttcaaacagatatgcgtgagaaagccttttcttttcaatgctattatgcaaaagccgcatcactctgggctgctgctcggtcatttccttccatgatattgccattgtatcactctctatgtgtaaaggttaatcaataaaccttttatttctccgattcgatccagcaaatcaattgccggtttttcctgatccaacatctcttccgtcagctgaatcagtttttcatctatttctttcacaagtcccagggtccggctgttgccgtacaggtcgaagcttttcgccgtctcatgcgataacccgctgtctacggcctcttttacaaaacgcttcaccagccctttgaattttgctaagtctttgaagttcctcgatttcgtcagtcttttcccgaacgtttctatatccgttaagaacctgcttagctgatcaaacttcagcttactgctttggctgtccattgaacttttaaaagttccggaaagctctgccactttataggcaggctgctgctttttctcaataaaggtgcgtaagtcagaatttattttcacgtcgtcaaatccttaaaattgatgaaattcatcgaccggaaggacaaagaccgtcgctccgccgacttccacttcgacgggatatggaacgtaagaatccgcattcccgcccatcggggataccggggcaatcatctgatcgcgtttacagccattttctttaatgaggctgagcgctttatcgacacggatatcttccactccgatcataaacgtcgtattgcctgatttaagaaatccgcctgttgtcgcaagcttcgtcaccctgaagttgtggtcggttaatactttcaaaagcctgttgctgtcctgatcctgcaccactgccactattaatttcattctctaggccccctttaggttggaaagaacattgtcgttacattcattatatcaacttatgagaaacaggtcacaactgaatttttttcaatgcctcatttatcacctgaagcgcgtcttgaatgacgaattccttctttctcgatgcgtcgattgtatggaatctttccggaaaacgctgcatgactttttggtacccttcccgtactttcgtgtgaaaatgcagcgcctcaaggtcgagacgattcttttctcttgaatcattcgacgtaatccgtttcagcccttcttccggatcgatagaaaaatagatggtgacatcaggcatcgtatcgccaattgcaaaccggttgatagaaaaaacttcatcaatgcccagtcctctcgcatagccttgataagccagtgagctgtcgatgaaacgatcacacagtacaatgcgcccttctttcaatgcaggctgcaccttttcgactaaatgctgtcttctggccgcggcgtaaaggagcgcttccgttttggcatccatcagtgtattgtttttatttaagatcacttctctgatctgctcagcaatgtcaatgccgcccggttctcttgtcgctgtcaccgggtgcccctccgccgacagaatatcttttatttcctgaagcactgtcgtttttcctgcaccttcaggaccttcaaatgtaataaataaaccgctcatgatttctcctcttctgtataaacaagtaattgttccccgtttaacaagccttgaatatgcgcatccatgccgattaaacgggaaagcttttgtacgatctcttctgttatccgttctccgtccatgataagcgggattcccggaggataaggaataatattccccgcatgcaagcgaccggccgctttattcatatccgtaagctcttttgcaaacttgcgcatttcattttgcggatattcaagtgtcgtaatggatgggaatgtccaatccactgcttccggcagtctatcgggcggtgtattctccagtttctgctgtatgttttttacggtttcctgtttaatcatccgccggccgcctatcggcagtacgagcaatacttgatactcgtcagccagctcggcaaaaatgccttcgctctccaaaatattttgtaatgaatagccggaatgtccgagctttgagcgaagaatgagttttaacgggtccgctttgatcccatatccggagggctcgattacttcaatagaagaaattgatgcgaagttccgttttatttgctcaatgtgcgctatatgaacagggagtgttcctttttcagcgatatcctgtatataagcgcgcgccgtatctaaagatgccataatcggatatgacgggctgctgctttgcaaactgcttagataataggttaatcgatctctgtcaatccggctgctgtttaaatgaaagtaagatcccatcgtcatagccggaagcgttttgtgagccgattgaacaactgcatccgcccccatagccaatgatgaaggcgggaacggttcacccaacacaaagtgagcaccatgagcctcgtctaccagtacagggacgccgtatgaatgagcttttttaactgccgcattcaaatcggcagcatgcccgtagtaagtcgggttggtcagaacaaggcctttcgcattcggatatgacgctaacgctttttcgatgactgaaagggatacataggaaggcacatgcatatttttatcaatttccggtgccaaatacaccggcttggctccggccattgccaccgcatgaaaaacagatttgtgacaattacgctgaatcaggatgggttcgtccggttcacaaacagccaaaatcatcgccaggttgccggcagtcgttccattgacgagaaagaagctttcctgagagccgtaaagcctgctcaccaaatcttgtgcttctttgatgactcccgttgggtgatgcaagtcatcaagccccgtgatctcagtcatatcaatagataaaagagattgatatacagatttggcttcatcaaaaaagacatctccattgtgatgtcccggaacatgaaaagaatacgtatttcggtgcgcatgcttcagcagcgctgtatataaaggtgtgtccatttttaaacaaatcctttgcctgtctttcttattatatcgtgcctgtgagccaacttaaagctaagactttttgccagctagacgtcatcacggccgagcgtcatattaagcagcttctttttcaagtcgccttccatgataacaagctcctcttcggcacgtttgcgtttcatcctgccgtcttcttgaatagacatgatttcttcaagtgtgctgactaagctttcctgcacttttttgagggtatctgcctcaacaaggcctcgctcattagctttggctgtctcgactgtacttgttttcagaagttcagcgtttttcagcagcaattgatttgtcgtatcagccgccttctgctgcgcatctgccgcactccgctgcctcataagcgtcagcgcgatcgcaacttgattcttccataatggaatagccgtaacaatggaggactgaattttttccgccagtgcctgattcgtgttttgaatcaaacggatttgcggcgcactctgaagcgtaatctgcctgctcagaagcagatcatgcactctcttatccagacggtcggcaaactggcgaagatcattcacttcctgcgcggccatttgattgtgttcccgtgattcggcttttcttgccgcttcgggaatcagctttgttttcagctcatctaactttaattcacccgccgctatatacagatttaagtcagagaagtattgtttattttgggcgtacagttgatctaacagtttattgtcactcaacagcacatttttagaatgctcgagccttctgctgatacgctcaatctgcacacttgtcttttgatatttcgaaagcacttcctgcacagaaccagatacccttttaaacaaacgggcgaaaaatcctttattcttcatctgcagatcatcagggtttacctggtcaagcttcctcatcagatcagcaagtatctgtcccatctctcccgcatcttttctttgaacatgctctatcatcgtgtgggaaaattccagcagattcgtttgcgcctgcgaaccaaacagaacaatgctttgcatgttctcatggtccagtttttcagcgagctgacgtgcagcttttcttttttcttccggcagcgtatctgcaagctttggattagcctgatcattttgaacatccatatcatcggaacggtctttggccatttccttccccctatcttattttctcaatgaatgctttgccatatctaattcaaagtgcagatcgtcgatgtcttctttcatcagttcatgaaggtcctcttccagccttctggaaagctccgcaagagtcatcctcgtctcactcaaggacattgataaatctttatttttccgcggctgtgatgagagcagaacatacttttccgttagttccgcaacggaatctagcgtttggtaatagaatcgctctgcctggtaaaagcgcttcggctcttgctttgtaagcacatatattcgccgcgttatccgcagtatctctgcattctgcttcagcatttgtatacttctagagcgaaaaagcgctctccgtaatcggatgattttatctctagcttcctcaagattttccttgatataagcatattcttttcttgtcagccggtgtttctttaaaaagagacgcttcgcattccaaagcccggccgcaccgactgccgctccgccggctgccccatataatagcgaatagagaaaaggctgatgccctatcgtaaagacggctatccccgctaatacaaaaaccgcgctgccgcaaagcgtccatttcatatattgaataaacggtttcatactcggatcgactcctatttattcacttttatcagtattatctattacattctatttctaaacaagttcctcttcttatcgtatcagttctttaataaaaagtgaaaaaactcctctgtttttaagcaaaaaaaagacccttttcagggttaagaatataacgtcggtgtatgaagggctttcagtttgcgaacgaaaaactcataattcggatcagaggttgaagtggaaactactttcttctcacactctaaacatataaatttcgtataaatatggatacccctgctttttttggtttcacacacaatgcatgtttcttcatggctggacgtttcattcatttttgcccacctccgtatgaatagccttcccctaagctgttgattgtatacacaatttggacctttttgaaggttgcaattagtatatgggcatcgtcgtatttcggtgtttgtattgtttttattcaatatttgtgtccgggcaggcaacgggccgccctggctgcagctgaaggagatccgcggccgtcggttccgatgcggcgccggcaggagagcatctgaaggcgaaaacgccccgcgtttacggagcgatcagggctgcatcagcagcgcgccgcgccgtgaaatctccgcggctcattgaagctgcggggcagccggattccggagccggccaggcgctggctttttgtgggcagggcaggcaacgggccgccctggctgcggctgaaggagatccgctcagacctgcaactgcatcagcacatggcgcgttgcttagagcgaagagagaaaaagcgcgccgcgcttaccatggtgctccggagccgctgtagctgcaggtgatccagagccgatagaaaggaaccgactcttttcaccaaataagaaaagacggctgcttcagcaatccgtctttttcgttattatttattttagtgaagtctaatagcatatttacatcaaagtcgaaatgtaaacttaaattattcgtaatgttttaagcttgcttcaatagatttaatgttactggttaattttcgaatttgtcttcggagagtatcattaacaacagtaggaatattaccttcttgtttatttatgaagctttgaacaacctccttttcttcaactgattgtttcaattcagactttagttcgtttattctttctttcatgagttcttttgttttttcatccattttaaaatgctccttctttaaataattgatttaacaatcaaactttttaaagctacaccgcctttttttcatccatttttgattactttattgtaaataagactctagtgccgtctgggtaaccagaaagcttatgtgatacccaggaacctgctccgcggttatcagaaggggttatgtattcgatgtctgctccgcttcctccttcagcgcaaaaagccattggccattcatcacgatcatatcctttttttgttgggatatctttcaatgattgagatcgattattttccgctccatcacggtcgatagtacacacagctgatttgcccttggaaattgcattttctatatgtttggcagtctcagggtatttatcagccggaaaataaattaccttgtcggctttcttatttgaattgttgtttttgtctgaagaaacatcgatagctttatcatgggtgaattcagaaataagacggtttatatcctttatgattggacgaataggtgtatttgggacaaagttgcccaaggcataaaggctaattataacggctcctaataaccctagaaattttttcatctttcccgctcctcataagggatttttataagcatttaaagctgctttgctaatctcactcaggtttcttgtaataaaacttggagctatcagagattaaggtgttacttactctacggattgtttccgaatttctttgaaatttattaaaaggggtattgtcgattttatacttttttctcaattctttaatcttaccggcgattataaaaaggtcatcttccttcaaatttgcaatatcacataatatttcgagatatagtttttcggtcatttttaatttcaccatcctgctcgtcattttgttttatcaacaaaatcaaaaatgctttgatcaagaggcttttccccttgcccttgaaacagccaattttttgtttcgcggttatattcccaaccagctttttttaaagccgcgcttaattgctctaagttaatgcttggtatctttttagcaatgcttgctaatgttatacctggttgtctggttgcggagagaacttcacgtaaggttgggttttcacctatattgattgaatttagttcactcaactctttatgccatttctttatatccgatctgtcgaacccttcctgggttagagtagaagggatttcattagggttatccaaataatattgcaactgttttaatgcttcaggtaggggaccgaaactgtgtattgttttgtgtctttgccctttccctgggactgtcacgccttttttaatgtacacataaattttcccttgtttttttaatttgactaagaagccgctctttttaaagtctgtcggagtggcgttactcttcgaagcatatctatgatttactttgtttctgtcaattttgtctttctgtaaataagcttctaaatcagactttaggtaacgatccgcaatagcttggatttctcccttatgcactctgttataaaatgtcacatgagaaatgttcatgtattccgcagccgctttgggatcaaggagttgctcggagagataatttcttattttctgttctttttccttatcagaaatgggttcatttgcgatttttattatctcgtacatagtaaacctccacattgtttgggtattgtttctctaattttccgtcctaaaccctaataatatcctcttattccgaatgttgaaagttccaaagggaggatgcgggcaagacataagagagaacttcccttgtgttaagtataacatatgctatagtaattgtatagcatatgttatacaaaattagtgaaggttcgacattgcttttgaaatttccttatcagttgcacgtataacggattcaacaaacttttcacaatgtctttcgtccgaaaaagaacggctatcgaagtttatatttaacgtatatgaaaactgtttttgatttaccttgtaaatcagagttgttacacattcataattacaaatatctttggtcttatcatattccagatccatatcatcgtactgagatttaatacattcgtccgcagtgtgaatctgccgctcctttatatactcacaagcaatagcttctatgacatgatgtatagtccgtttggcagctgaaagataaaggtcacagtgaacggatgggtttttaacggttgttataaaagttgggtgagcatgcgtttgagccgctatttctgagtggatgatatccttgaattcagtttctgctatgcctgcaacttcatccaatgtaaggaaatcaagcgtttgagaatggtcactattgtttaaaaacatattcttattttttctcacctcgatgctgagtgaagctaacgcataatagcgcatctgctgctgaacacgatcacctagacatgccataattttttctttgtttgcttgagtggcaggcaaaccattgctttctaatactgccgacaggtcttctgctttaagttttgttaataacataagaaccgctccttattttcgattatggagagcattcacgcggggaatgaaccacgcgtgaatgcaactaagcattaattattaataatggtgccgcaaaatatatgaattcgattattggtatgctggatcattctgacttggacatcctcttgtttagagatcgaaaggtttttagctttcttaaagacgcttgcaatgctaattgggctttcgattgtttcctccaattgatcttttacaaacaaatttgcttcgaaaactcttgttttcatctgaaccgctccttttcaaatttattgtgtgaatgtcaccatcacctgatgacaatttaagtataacatatgctttactgatagtaaagcatatgttagaaatgtttatttatctttttgatataacgtgtaaccgcatctgcaaaactcagctatttgttcaggtgacaacccgattgtttcgccctgatcgttgactgatgcgacaaaaaatgggccgtggatacaatgtgtcttaccgttttcagtaattttgcaatagtattgggaattgtagaagccctcttcgtcgaaccaaatgtcaatgttattattgagtctcaaacattcgaggttatcggctcctacaagattttgccgttcttcaagggtttgcggcagttcaacaaatctgttgttctgatgatcaaacaaaatgattttttccatgaaactacttcctttcaaattttattgtgtgaatgtcaccatcacctgatgacaactttattataacatatgctttaccgatagtaaagcatatgttataaattattttttgaaatttccatccggcactctcagctgacagataacatggtttacgaattcttggaaagtaccttcgctacttagatcatgaccttttatgttagtcataacggcgtaccattttccgctcttagggaaataaacattgttaatcatattaaaaggatcgtcattcttttcaaagttttttcctaacatttgagaaggttttacaaaggatacattacattcttcgtccacatacttattaatcgagttaaagtatctttttgcgatgactttaatcaggtaacaaatagtttctgccgtttcaaaaaaagggggttccgttatggaatcgaattgcatctcagaaagaaattctatagttgcagtgaaagaaaaactgcctttagttctctcttccgctatttcagtgaactcattaagagtaatcaacttcgctctcttccgatacacatcatcagaagtaaaagctattttgttatcctcgatgtgattcagcaaagtttcaaaggcatcgtgccgaatcgtttcttgaatttctactgtgtccaactcttgaaagatcaatcttatgttttccttagttgccggtatgttgtttctttgaagagcttcaataaaatccgcttgtgccagtgtgacctgaaacgtaaaattcattttaattctcctttacaaaatttattgtgtgaatgtcaccatcacctgatgacaatttaagtataacatatgctttattcaaagtaaagcatatgttatacattttttcttttgataaaatcattccttttctttataatgaaattaatgattttgtaaggactttacctccttaacaaatttattgtgtgaataggttgcggtgtgcggaaacatgccgcaactcttttctattatatgctttactataattaaagaatatgttagaatttaattaccgtcagttgatggttttcacacaataaatcttttggaggggttaaattgttaccacatatcaggaaaatgagtcttgttcatgattatctttataataatcgtgaagtagctgaaagatcgaatgatgggaaggatcaagtgagagaccgttttatcattgttactacagaagaggatctctttgctgaagaaatacccgctgaagaacattatctatattcagattttaatgaagtggtaagtgaactgcgaaacacggtaaatgatatgaaagctttaagggaattttagaatattttttctaacatatgctttactatcgttaaagcatatgttatacttgaattgtcatcaggtgatggtggcattcacacaataaaatttgaaaaggagagtttttatgggaaaaatattgattgcagatttgtttattaaggagaacaaaaagcatttatgcgcgttgggaactccggaagacattaatgttgtttttgacaaagcttatcaactccgaaaggaacataaatgtgcaatagacgttaggattgttcggcttagtggggtaacaacagacaaggtatctatcagtattgaagaagacagttttaattacgatttccataacgagttagatatttgagaagagggcgaaagccctcctcattcaaaaaatattaaattgtacggaggacttcaatgaaggatataagagagattttactcgagagattggtattattggaacgcagttcattatcattaaatgaggtggaattcgcaagcatagttaatgctgaacctgttgttcactatgcgaaaaaaactgttccggtttggacaagagagatacatcatatgctctatcgaggatatatctggggagctgggatgtttatgcgtgtcatgcgtgaagaattagggaaactcggtcttgatgttgaggattggaatatagaatggcaaaacgctttcaacttaatgaaattacaccgaatagaattcagggatttcttacatgaagattttaaaggaacctacgaatggacacatgaatttgccctatatttaaatacaagattgaacgaatatgaaaagcacggtgaactagataatgtatcgagtatagaaaagaactacttagaaggcatcatgggaggtaaagcggtatatgaaaggtttttctacgataaagaatatttagacgccctatgcggtaagaatgcagtttgtaaggcatggaaagaagtgtggaagattaggaagaacccagcttaaatttttaaaaaaaatgtataacatatgctttactatcggtaaagcatatgttatacttaaattgtcatcaggtgatggtggcattcacacaataaaatttgaagggatgaagaaaatggagaaagtgattgaagttcttactctgaaacaggtaaaacatgaggttgactgtccagtatcagtcataagaaggcctgacgacgcttttaaggtctatgaacactttatagcagatgaagcaagagaggtgccattggctatctatcttgacgttaaaaacaacattcgtgccatatataaagtatcgataggggatgttcgcagtgctatcctcgctccaagacaaatttatcaggcggcacttttaaataatgcttcgtcagtaatcattggacataatcatccaggcggtgatgttactccttcaaggcaagatattgaaaccactcagaggatatatgaagcaggaaagctaatagggatagatcttttagatcacattatagtgagcattgaaaatggagaaaagaaacatctttctttgaaagaggcaggatatattaggaattaaaagaaaaaaattttgaccaacaggttcacaaagtaaaccgaaagtgtttactttgtgaactatatagtgtaaaattaaggtaaagaaggaggcagtaatatgaaaaaatctcaacaatttctgaaaggaacttttccttacttgggtcatcctgattatgatgggaagccaactaatgatacgctcgaaacctttgatcagttgttttcacatttccaagaccatcacaagaacggctttgacctcagacggctgggcaacctggagccatcgcttatgttacttgcagtggaagccattgcgattttctacaaagaggatctgtacagagaaaaggaacctgatacggaatatatcaaccttacagataccgctaagttgcttggcatttcaaaacaaactttacgtaagcgaatggaaaaacaaagtccgccagtaccaaaaccagatcactatgtgagcggtgtaccggcgtgggaaaagaaagctgtagaacagttcatatgggacaacggtctttatgataatgatggaaaatttacttaccctgttcgtgaagaagactagaaaaggagagaaataattatgaaaaaaaatcttgccacattattggaagagcggaagcgatcacagtctcagttggataaaaacgaagtgatactaattaaggatgcaatagaagagttttctcacagagaagagtttgaaccagctttctatttacagcgatttttgagctaccatgaactatcctcacggtgggggtggctgcttgttgagaaatttcttgcatatgtgagaagagaagaaaaaaagctgtctgctttccgttaatttaatgatgccgacacaattgaaggaggctttgacaatgaaaatgttcggctatgtaaggggtctgtatgatttggaaagaatggcggaattgtatgggtggcagatcaacacaacggatcatcataataaggggtcagactttgtttatctttttcatgaggaacgggattttttagtagcggtaaatacgtttaatggtcgattctttgttacacatcgattaacgaaaaaccttgtggctacggatcaaagtgtcaaattaaaaagtgaaaaatggtatgaggatttgctcagaatcctttataaagaggttccatgccgtttcttaaataaaaaagagttcagccgccagctgaaccctcttgaaaccttaaaagcttctcacgctaaaaaagatttcatgtaaattatagcacagatccgtttattcctgtatgggaggtgcacgaatgacagccgctgaagtcgcggtgatattaggaattttcctgacatctctgcacatctgtgaaaagcttctcacgctagaaaagatgttaatagaaagaaagtcaccaaagaaaaaaaatcctcggaaagcaagccgcaatagtaagcgtaagtttggataggggagagggtgcctctccccgccatatacgggttgtcaaatgatatgaaattactcaagaccataaaagagattgttttctggctgttcatctttacttatgtctttggtatccgtacagcggttagcggcggtgttcaaaaagctttagacatattgatcattattgctgttgtttgttcgttaattgtactttggacaaaaagtagacaagcctaagcgggcttgtcttgaattaaaggagcagataatgtgaaaaaatttgccggtgtaagatcattggacgatatgagaacacaagcgattgaagcaggatggaaatttgatgagaaggcttatcataaggagaacagtgactatgtattcctttatgataaaacaaaagatgacattgtggttgctatcaatacattcaatggccatttctttgtttacaataatgcaactgatgaaaatatagctacgcatttaagtgagcgatttgatcaagaatcttggtacgttgaaattttgaatattgttaataagccgtacgtgaaaacagagcggctttaattcactcagcacatgcagcaggcgcagcaggtctgcgctttcttcacaaatgatacaacattgaacatttttcgttttgaaccggtttaaattttatcggtgagaggtgtttggaattgcagtatccaggagattacgtaacgattgtaaaaaagccttctaataggtatgaccaaggtctcttcgagatccgtggtatacccaataccttctttgaattttcatatcttggagacagaggttttatagaaattaaagagagcggtacagcgatgcactgtgtcaaccggaatgttaaagaggggaagcctgtttcatataactttagcaagaaaaatattgcatatctcagagagcagataagatatctgctggacagacgattatactaaaatatgtggtttataattgatgaataggagtgttaaatgtgtatggcggtagcctaaacgatatagaagcgaatttagagcggcttttagaagctgaagagaaatcattgtcttggagcatttcgtttatgtgtgaggaaggaatagaattagaatcagtaggaagtgtgtattatagcgggaacagcttttataatgccgaggatgcttatcaatatttaaaagaaaaaaaccttctttcagagttttcgcttagccagcaagaaaaaatcatagatcggattaaagcatttgtgaatttgcagatttctgaaaacccaaattactgcagccattcagggtacaaagcttctcctgaatgttatagggaaacggaaaataaaataatggtagcttttatagatgattcagaccaactctattttgatgctattatagacaaaatctgtggcaatgtgaggtttgagtatctggggcaatacgagacagagggaagccgcccttttgaaaacagatcgtttaagataagtgtagaaagtattagggggaaataatatgaaaagtacaggtgttgttcgcaaagttgacgaattagggcgcgttgttttaccgattgagattagaaggatatttgatatgaaacataaagatccagtagaaattttcactgagaatgatacgataattcttagaaaataccaaccgcagaaacagtgtgcgatcacgggcacagtgtcagatgaaaatatgacctttagcggagggattgttctgagtccagaaggatgcgagaggttagtgtctgaattaatagaattagggcgccgataggggtattaaaactcttctgtgtaaagggttaactaaggagatgcgggtattatgacaatggaacgttacttaaaattaagatataaaggaaataccgtgcaagaaattcaaaatgaatatgaattaagcgaaagcaccgtttggacccttgaattaggttatacttgttttctcaaagggattccgctagatgaagcgattaaagctatttttagcattgagagcccacaagttcattaatacggcgccagctagcaatctgaaggcgaaaaacgcttcgcgtttacggagcgatcgggagagcgctggctgcgcctctcctataaaatctccgcgactcatcacaagctgcgggagcaaccggattccggagccggccaggcgctggcttttttgtggccaggtcaggcaacggatcgccctggctgctgaaagagatacgcggccgccggtcccgatatggcgcctgcaggagagcatagaaggcgaaaacgccccgcgtttacgaagcgattgggaaagcactggcagcgccgcgccgtgaaatctccgcggttcatcgaagctgcgggggcagccggattcgggagccggccgggtgccggcttttttgtgtccaggcaggaaacgggccgccctggctgctgaaggagatccgcggctgtcggttccgatgcggcgccggcaggagagcatctaaggcgagaacgccccgcgtttacgaagcgatcgggagtgtagcggcagcgccgcgtcgtgaaatctccgcgtctcatcgaagctgcgggcaaccggattcgggaaccgcccaggcgccggctttttgtgttctggccaggacgggatgccctggctgctgaaggagatacgcggccgtcggttccgatgcggcgccggcaggagagcatagaaggcgaaaacgccccgcgtttacggggcgatcaggaatgcaccggcagcgccgcgccatgctccgcgtctcatcgaagctgcggaggaaaccggattcgggagccggccaggtgccggcttttttgtgtccagagcaggaaacgggccgccctggctgctgaaggagatccgcggccgccggtcccgatatggcgccagcaggagagcatagaaggcgaaaacgccccgcgtttacgaagcgatcgggagtgtaccggaagcgccgcgtcgtgaaatctccgcgagctcatcgaagctgcgggcaaccggattcgggaatcgcccaggcgccggcttttttgtggccaggtcaggcaacggatcgccctagctgctgaaggagatacgcggccgccggtcccgatatggcgccagcaggagagcatctgaaggcgaaaacgccctgcgtttacggaaggaaccccaccaaaaaggtggggctagatatgcaatttcttaacattttttatgttatctgtgttatagtgaagttgctatcacgccacagcattattcaaatatgttgtgtgttcgtcatgggataattcccacctatattagccgttggtgggggagaaaatcgaaagtgaattgtgcatgtggttaataattgatatctgttcttgtgatagcgaaccagatacaatattaaccgatctaaaaaggaggagtggaacatttaaacctgggaatttaaatgttctaacagatggctccttgattaaatttttcgcgaatagtttaatcatctccaatggaaagactcctggcgtgggaaccaggagttttttctgtatatctgaacattttttagggaatacaatataatgcacaataaaaggggaaacagtgtgggatttggctgcggttgtgtttaagggtaatctccttgcgtttctgggaaaaacgcaaaccaaaaactgtttccctcttgcaattacttatgggccaaaaactactgtgattgggtgatcacagcaagcaacaagcagtttagatgttcattctttccaaaacctataaaagagcaaacaaacgtttcctatcttgatcagccaatctaggtgttgtttgattttattttggttcttcctgaatgagttaattaaatttttcgcaaattttttcacgctaatcatctccacggttttattcacaaccgcaggattatggatattataccagttatttctgtttagggggagagaccaggtttaagatgcctggtctatttcttgttgtgtttatgctaggatatctgggatcaaccaaactataaaaggtagtggctggttaacggtaggatgttgtattgacacattgaatgaacacgatttttcgttcaaatgacttgttaatttcatggggttccgagaccttgtttgtctttttggtatcattagcatcagaaaatttggatatattgttgtgttttgtattattttagggtaactttgaactgtaaagaaaacacaaaatagggagtgatgtcatggggaaatagaaaaatctattctattgagccgtagataggttttattccagaaaagtgtgtttccttaaatttcgcttgcttcgcgcttctatatatctagttctccatttctccatattagtgcgtgcataattgctctgcctctcagaaataaatcctcatatatttaaatcctccatagaaaaggattttcaagacaatatgttaatagagccataaaattggcggaaatcttctcatttccatagggcgtttctctttgaaaaatgagaagatcgaagcgaaacatcttattttggattataggctcattcatcattgaaacttcactcactatcattcttaattgaaaggggtacaaacctacatgaaattgaatttgaaatactggtcgatggcgattgttctatgtttcactctttttggtttcttaggagcaactaagatacaggcagctgaagtaaaaacagaggcgcaaaatattggccttgatgctaaaaaagaggaattagcatctcaaatcaaaatctatgatgaaaacgatgatgaaattcacccttacacgttacaagaattgaaagatatgattacgcttgatgatcaaaatcaagataatccaatccatgcattgtataagacatatacaagcaaaccatttggcttcaagtataacttttcaatagggggaggaacgtatggaaaagcgttcaaaaacccaataacgcttttaatcacaccacaagggactgccaaaaagttctctgtagctgcgaagtacgataatggcaaaggcggtgtaggcggaacagcaggtaaaatttctcttccaggcgggtggacaggtcaaattcatatgaactggactcagttgaaaagagggaaaagttatcactttaacttcattaataacagcagcagtgatgttgaagttaaaatgaagaaagttattgtatggtatgattgattaacaggcaggtctgaaaaggcctgctctttttgtgaagttgaacagaaaaaagaaacccggtcagccttatcgggtttcggaacatactcttattcgtttatggtctttaaatactcttgatgttccttttctaagacttgaacatcttctttgaaaatttcgattttgtaattttctttaatttcatcagacaagttttcatttagatactcccgcagttttgcttcactttttgttttatccattccaattgaaataacgggatctgtttctccaataccataactaaataatccgaattttccccatgcatcatctaatacttcctccggtggtttttgcttcggacttgttgcatgtaaagcaatactaaacatgaataaagaagaggctatgattaagactacagttaacttctttttcatctcatccctcctttttttccttgctattaatatcctaatagcttagctaaaagtatatcacgaatcataatgaagaaataccgagtttcttcctatataaagtacttaatgataacactatctttcaggttctaatctaagcttttctatatagaaaggaaaatccgcggccatcggcctcgatacggcgtcagcaggagagcatctgaaggagaaaacgccccgtgtttacggggcgatcagggctgcaccggcaacgccgtatcgtgaaatctccgcggatcatcgaagttgcggggcatccggattccggaaccgaccaggtgctggcttttttgtggccagcgggcaatgggacgccctggctgaagctgaaggagatccgcggccgtcggctccgatacggcgccagcaggagagcatctgaaggagaaaacgccccgcgtttatggggcgatcgggagagccatcagtagcgcgccgcgctgtgaactctccgtggctcatcgaagctgcgggggctgccggattccggagccgaccaggcgccggctttttgtgttctgaccaggacggaatgccctggctgcaactgaaggagatccccggccgtcgttctgatcggcaccggcagaaagagcatctgcaggagaaaacgccccgcgtttacggggcgatcgggagagcatctgcagcgcgccatgaaatctctgcggctcatcgaagctgcgggggctgccggattccggagccgaccaggcgccggctttttgtgttctggccaggacggaacgccctggctgcagctgaaggagatccgcggccgtcgttctaatcggcaccggcagaaaaaacatctgcaggagaaaacgccccgcgtttacggggcgatcgggagagcatctgcagcgcgccgcgccatgaaatctctgcggctcatcgaagctgcgggggctgccggattccggagccgaccaggcgctggctttttgtgtccagggcaagctacgggacgccctggcagctgaaggagatttaagaccgttggtccgatcggcgccagcaggagaacgtctgaaggagaaaacgccccgcgttacggggcggtcgggagagcaccggcagcgccgcgccatgaaatctccgcggctcattgaagctgcggggcatccggattccggaaccggccggtcgccggcaagtttctaaaagcaaaggtaactggtgtcgttagcaagcatgctctcatcggtgggggttatgaatagaagttgaaaggatactacaaagtgataaaaagtatcaagtaccatttaattaatttgaaatcattactcaggggtttacagggcgaattggagtgtagacgcctggtattgcggcgaagttccgaggaatatcatgtgaaagagtatcaagtaccatttgagtttttgataaaaaaacgaatttctgttataataaaataacagaacaaattagttaaacgaaaaaaagagagacgttcaaggaacttggctgcagcttttaccctccattaaacctggtccgtttaatgtaagcctgttcttgaaagaccctctattcctaatttttataaaatttctttaaggaagcagaaaattaataagaagagtctgcctagaacgacaaaccattctaaggtcttcttgattttctcgcttcttttttttatgtatgaaaagaattttttcactggcctcccccctttactgcttgatcagctgcgggatactttaattatagcatagttggtttctttgactgttgtttgggaaattaatgggttcacttgtaagtccatgcccagcacggttctatgtttttgttgctgtacagggagaacgactcttggagcagtttttaattagcctctctaccgtctactttatttctcataaataaacgaggtggaatcgatgaatggtatagaatttttagaatctgtggcgcaccttggacaattagttttagtgttctctggctacgccctctattggaaactaggtaaaacaaaaagggagcgaaggcttacaaaatttgaaacctccattaggttctctgtaatgttcggtatatctgcatgggcgctttcgtctcttgctttaaatttgtggtcataatcttccgttgatatttgaattaataaagaaaaggcatctctataatgagatgctttttctttattcaaaagaaattccataatgtatgcttttacataaaagcatacattataattgttgaaaacactgagtttttttcattagtgtgttataatctatacaagtgaaaaaagcatacatttttttcgttgattttaaagggtttagatcaagcggaagacagaaacggatgtagtcaatatcactggttgggaaaatgaaataattacattatcaggaaactggggaggggataatcaattgaaccgataaggatttaaatatgggagttgattagatgctaaagtgtaaaaatgctcgaattcatgaatttaggcttcaagctgttcataaaacaccagtcctgtttgttatagaagatttcatgcaaaaatttactcttatcgctatcccacagtgggattggtcctttcagatgacgcatacagttccacgtgatctgaatataaaacagttacagcagtcattatcagttgccggctttattaattacgatgaatctggcttcgctgcaaatacaatatctgatatcgtatttaatgaaataccggtaaaagccgaatatattgaatagaaggaatttgcaatgaatcagttacaagatgttcagccaatacgcagtttagaaaaaatagaagacatgaagtgggccttgaagagattttgttctgaaagagactacatgtattttttgattgggattaactgtggtcttcgtggcggtgatttagttcagttgaaacagtctcagtgcaggagaaagaagtttcctgtaaaggaagggaaaactaagaaaaaaagaaatattaacctgtcagcaatatacgatgaagtagctgcttatattgataagtatccgaatgagtggatgtttccatctcaaaagggaggacatattacaagaattcaggcttaccgaatcttacggagagctgctgacatggctggaatagaaggaatgggcactcacacccttagaaaaagctttggttattggcattacaagcaatttagggatgtagccaaactccaaagtatctttaatcataataatccagaaacgacattgagatatataggaataacagaagaagaaattgatcaagatcttgaaaatttcaaattgtgatctgatcaaaagagttaaaaaaacagccctcttgggttttatggcaggcaatgggcgatttcattcggcccctcatgacattggctgacttgtccgtcaacgggtagaatggatacaaaaaggaaaggcggagaatacatggcatatcgtattgtgggcgagttggaagggacggaaattacgttcacgagtacacacccagacagagagaaacgagaggagacattcgagacgattgaggaagctgaggaagctatgaagacctttaaaatgtctctgcctgaaggaacaaaattgacgattgaacctgcggtgtagaggcaaatgattgattttgaaacggctatgagacacgtgagagcaactcttggctttgaaggtttagtgctgacggaagaagaggaagagcttttagaaagacggtttcatggagaaatcacagaggaagaatacatacgaaaagcattggaactgtcttactccggtgactaataaatagggcagcgagcaattttggtgtgagtcaacggttactggaccgtagagaggattgaggatagaaggagaaaatggaaaatcagatcgtgaaatttgtttattgggagttggtgtagtcggtggaagttctacaaggtcgagaaatgccggatgctaagtattgggatgaaaaagaacaagtttacaaaccagtattagctgttgattttactccggaattaagaaaagtaaaaactgtatgtaaatactgtgagcaaagtgttatcttcgtacagggtaataagaaagaggattctaaaccattttttaggagatctccaggtgtatatcacgttgagggctgcccgtatggacagaagaaaactctaaaggatgaattgagggaagtgggtactttggaagggctactgtatggtgtaaagccgccccttgctgttcaaagggtgaaaaattcatctgtccaagaaggcgaaaaaagccaatctgaagaaagaccaagatcattggagaaacagcctcgtcagcaggtgccgaataaagataaaccgcatcagaggaatttatttggtgtagatgatttatttcatgaattaaaggatataagaagtcaagagccttcattaatgaggaaactatatgaaagaatcattgggaatgtatattacccttataaagagtattctctcctgttggaacatagcaagaaaggaaagctaaggaaatacttttacaccgctggaatattcaaagcaaaactggaatacgacatgattgagaataaaggatacatctttttgtatggaaagggtaatggctcaattaaactacgcctttatcctggagatgaaaaggtaatgacacaattaaaaaggttcagatacaaggtagcgaggaaagaaaaaaagaaaactgaatttattggagtcttagttcaattaaggcagataagtaatgaagaaggagttacatatatagatcttgatttatacgacttctctataaatcactatatgaatagttagaaacttttacggcgggaaaatgcgccgttttttgtttggattccaaaattttcttcgtttttcattgggtttttaatacttttggaataaaattagactaagtaattagcaggaggaacaatggatgttacgaaatgacctcgtttttaaagagctaacgattttgcgactccaagaattttacgagaaaaccggtagatcaccaaaaaagaaagatattgaaggcataacaagaattgagtctgcttttgggagttggactgaagctctcattgaagctggttttttccggaggagaagaataactgaacagcaaaaattagatattaaaagaatggttaatgaaattaatgaatctcataaaatacgattaaaaaagaacataacgcccccacctgaactggacaccatggtattagccttggctacagttaagatattgaaggcgtcacctaacgaattattcacgagaaagaagataaattccctcttaattgattgcgttggttcaggccccagccagattactcacatctttccggttatgaacgaaattgattatagggtactgaatccaaggaaagggtgttatgtcttttatccagctgtaaaaggaggggatggaagtgtttaatgaaagaacagcattgaaaatgcgaatggagcagcttaatgagagagagcatataattatacgtgaatttcaggctgagcgagacactatttataaacggctccgcgaacttgataatggtaagcatgcattgccatgcctacgtgagttagcaaaacaagaaaaatttataaatgatgcatataaaagtggagaaattatcgttccccatgtcagcgccgcccgatcagaaaattctgttgtaaaaaaaatagatcagcgaaaacttgcgatacagtttcttgcttctcaaattggtaaagaagtgaaaagcgttgacataaaaaggtatgttgaaaggattcacggtgaaccaattcaaaacatgaccatgtttatggaaagcttgatgagaaagaatccaagactgaaaaagattggtcgaggattatatacgtacgccgggattggagaataggcagagagcgaaatccaattctggcttcagggagattgcccgatattgaaggagcgcaaggtgactgatgttatcatcactccacacaaccaataaatttggcattacagtaaggatcgcgagcactaaaaatttttcaacagagaccgcttcaagaaattaagtagttacacccttgtatggaatttccacctgatttattgttggtatgagttaatttactctatagggggtagtgcatggtacgcagaggaatcgtgttccttttcatgataatggtacttttaataacagcatgtagttctcaatccagttcgaatgtggggtattgggttttagaaaagaatagagttaatgaagatcacgatgttaaagagtatgtttcatatcttcaagagcataaagacattaggggatataaagaattcaccatagcagaaggaatgcagatggtagtggtttctttagggaacagcgataaggaaaagcgacttgatgttgctcatgtcaaaaattcaaatggagacataaaattaactgttgatgtacaaaagaatgaatcaaataaaacaaatgagaaaaacccttatgtcatgattggcctaaataataaggaagatcataaattaagcgtgaccgatcaaaaagggaataagtttaaagaggttgattacaaataaaaaaatctggcgagaagcagttttttcactgtttccagcttttatgaccagtggccaggtaatgggtgtcctggcaaagaacctgtgaccgtcggctccgatgcggcgccggcaggaagatcatcagcgcagaaggcggaaatggccataaagcaagatttcatacttatgtggagactgttccttacaaaatattcattgacggaggattagccagtaattacggcggggaaggcggccgcgcttttaagtcatttttgttaggggtgggaattccggaagaagaagtttcttttgtgacaaggtataacggtgaagaaatagcagtgattgagatagtcttataggcatctgaacaagcgagaaaataaaagaatggtgttgcataaaactggaacggggggggttcttatggaaataatcgttagggataacaagaccgtgtctaagaaaaaaagctggtacaatcgttttgaatggattcttttgaatacttcgcttttcttcatctggttatggttagtatttacgttatttctcaacatgaattacatgattaaattttttgcggagttgaatggttttattggcctgagcgtgtttttaggaggtcccttactgatttggtatgatcacagagaagaaggtcatctaagagctttgggcgcttatatccattcgaatattctcagtaattctgctgctgccagcattattactctattagcagttaatcttttctttgcttataattcaatctcggtccttatagaatggtgtgggcgttaaaaaggttgccgtaattgaaatagcttttataataaacaaaaaagcagccgcaggaagacggctgctttttgattgtttgtagacatgtagacgtgtctactttttatcgttaaatggttactgctttttcagctacttgaattggtttgttagtaaaggttgtatctttcactaagggctgcgcagcagccagtaataaagccgaaacagttagcaggaaacgccctgtgtctacggagcgatcaggaatgcgtcggctacgcctcttccatgaattctccccggactatcgcagactgcgggtagcaggattccggaaccggctaagtgccggtttttttgtggccagggcaggcaacgggccgccctggctgcagccaaaggaattgtgcggccgttagccccgatggggagccgatatgagagtgtccatgctgaggcgaaaaagctctgagtttagggagccaatcaggagtgcaccagctcctacgacttccgtagattatttttagaatcactattttttattttctctaattcttctatagtgtatgtagtaacaggcgcagcttgatcaccatctttatccctccaccctttccacactcgttgattgtaattatcttttcttttttgttcccattttttttgttccttgctagtacccgttgtatacttacccttttgtgcgaatctttttcttgctttttcgctactcgtgctaagtgttggtcttacattattcatcgaattcagttcttcctgtctaaatctcatctttttctctatagcttcaggagacttcgctctggcccgttgtttttctctaatctctctcctttttctttgactcggcgtttcattttttatttgattttcttctttcattttaaaccagccccttctaccaggatatttatgcaaaacttcaatcatttttattataaacaaatgatatctttctctcacttatatcttgccgttggtcctgatatggtgccagcaggaagaacttctgcacagaaagccaaaacacccccgcgtttacggggggtgatcatgagtgaactggctatggctccatcgcaggctgctgaaggagctccgcggccgatcgcctcgatacaatgccggcagtactacggagccggtggtcggttaattttcattgagagccacttaaatatttgtttgatatttgaatcttgagaaaatacccaaaaaggggaatattctattgattttttaaacccattaaatagaaatatgataaaatattagggggtatcatataagggagggaaaacgatttggtgagtaaaacgctggcatcttcagaggtgggacaccttataaatcaatggtatggttatattcgttcttttagtattccagattcagagtatttaaagaaagaaattgagaataaacttgatcaaatggaagaagaccaagatctgcttttgtactattcacttatggagtttcgacatcgcttaatgttggaatcccttgaaccattagaaaaattaagaattgatcagcagccgaacctttcagatttattatcagaaattgagaataatcagtctcgtatcaaaggaatgctggactactattttaatttctttaaaggacaatttgaattttctaggaagaattatattcaagcgatacaatattataaacgagcagaattgaagctagatctaattcctgaagaagagaaaattgaaaaagcagaatttcattataaagtggcagctgcttattatagaatcaagcagaatatgttttcgctgcatcatgcagagatcgctttaaatatgttcgaagccaataaactctatagtacaagtaccataagttgtgaaatgatgttaggagcaaataagcttgatcttcttcgatttgatgaagcagaggcccattatacaaatgccatgaagtttgctgaattgacaaaggataattattcaagaggattggcttgtcataatattgggttaagctatgcgcttcaaaacaaaagtgacttagctgaagaatatttccgaaaagtccttgaaataccagaatattatgaaactgaacgtgggttaaggactgattttgaattgacttttgtcttgtataagaatggtaaaatagaagaggcacaaaagcttttagtaaagggcatcaagaaagctgaaaaagaaggtgaagcagagtatttggcgaaatttaatattgtccatgctctttacggtggcttagaggcacaaaagcgtgatgatcttattcagagagcattcaaatatcttgaagaaaagcagctatggacagatattgaagaattgagccaagatatcgcggaacattttcgcataatcaaggattatgcgaatactgtattatatctggataaggtgatctacgcgaagaacaaaattctcagcgtatcggaggaattaatgtgaagaaaatagtggctgtcgcagttctcatctcaattatggctttatttttctctgtatttcataataagcatgatgagaaacggttggctggcagggccgaatatgcaatacagggaacacattatacggctttagccgatggacagtttgaaacccaaggtagagctgaatttgcatgatcctttccctccgacgaatgttcggagggttttacgtatgacaaattttatatttatcatcaaaaaatgattctaacgcaaaaacaaattcaaaggggagaatgcctgtatgaattttagaagaggcgtctttatcattgtatcgactatcgtattaatgtcagggatcggtctaactgcatcggccgtttcattagatggatcatatcaagtttcgtctgatcgtaatcaaacctaagaaggagagtgcctgtatgaatctaaaaaagagcgtcttcatcgtcctgtaagtgggttgggtatgaacttagtagagaaacaaacacgagatacaacccaggtagcgtctgatcgattttgacttgaacaacttacgccttttcttcggaaaaggtgttttatatttattataaaatctcaaaacatccatctgttctttttcttatcccatttcagcaaacgctgtctcatgagattcttaattgcttctcgtatagcgcgttcatctttaccagtttttctcttcaattcttctaaggtggggtttttcccaaagtgagtcatgttaaaaatgatccggaacactttcctctcaaagtcattcattcaaactgcctcctcgagtagataataccagaacggacctaactatggggaagccagacatctgaatgcatggggccgatgaaggagatccgtagctgttggctgttattagggcaaataaaaagctactgcagctgcagtagctaaaaaagggtttataagccgcaaaatcaaattagcgggaagcgtaatcaatccagcttgcgttataattcacacgttttttagaaccctgattgaccattttaaatctatatgaatctcctttttttaaccaaggtgtttcaaaataagttactccatttttctttgcattaaaggttttaattgttttccaagcgcctttgctgttgacttgtttttggatgtatactttatacgtgcctttccctttactgctagacttaattctaccatcttccaagctgaatttttttgttgtttttgcgttgaatttagggtgctgtgtaaagatcacatagttagtgaaatacccactcttataagtatgcaaccagtctttagcttctgctttttgtggagaagagaagcccataaaaccaatgccactaattaaaagtgcaaaaacaatgattaatgacttaaaaatctttttacttttcatggagaaaatccttccttcctgtaactatttaccctatttatgttaatggcaatataaacaatcataaacccgtctaacttactattttgaatgtcagaagaggtgggtttaacctaaaaatgactatattactaatacttatgattcattattttgtttggcttgggaataaagttgttttatgatgatgcggaatatatctgtttttatatcaattgtcatgagatgattttacgtctagttctatgtgtatgggcggcaaagtaaagggtatacaagattcattataccggaagcccaagcctgttaaaatgcggtgggtttatctccctcagcgcagccggtcttcttgcagtggtgtatcgaggatgatagtcgcggatctccttcagtagacagggcgtcccgttgtctggacgcaggggcataataaggccgatatctggctgcctgcggacccgcctgccccgcaacttctatgatccgcgcagattttaaggtgaaggcgctaccgatacactaccgatcgctccgtaaacgcggggcgttctcgccttaggatgctctcctgccggcgccacatcggaaccgacagccgcggatctccttcagctgcagccagggcgttccgtcctggccagaacacaaaaagccggcgcctggtcggctccggaatctggcagcccccgcagcttcgatgagccgcagagatttcatggcgcggcgcgctgcagatgctctcccgatcgccccgtaaacgcggggcgttttgccttcagccgctctctcctgccggcaccgcatcggcatcgacggccggggatctccttcagccgcatccagggcgtcccgtatctgcccaggacacataaaaagccggcgccaagccgattccacaatcctgctgcctcgcagcttcgatgagccgctgagatttcatggtgcggcgcagccagcgcacgcctgatagccccaaacgcagagtgattttcgccttctacacgcggtctgctcgtctgtggtataaattggtgaaggatcgtatctataattacctttaaaacatggttgcatatataactagtgtgttttacactatagtataaataagaaaacaggatggttgattatgaatagccaacttagaaaaggcgtaatggaactgtgtgtcttggcaatgataagaaaagaagatttatatggttacgaattgataaggagtctaagcgaaaaatttccggtaaaaggtgaaacaatctatcctgtcctgaaaagactgactaatggcggcttcttatccacttatattggtgaatcatcccaaggcccaagtaggaagtattataaaataacgcctgaaggagagcgtcaatatcagctcttacacgccgaatggtcagagttttccagtgtagtgaatgaaatatttgaggaggaagagcattaatgtcaaaaaacgaatatttaaaaaggctccgatcatctataaaacagttaccaaaggatgatcaaaaggaaatattgcaagatattgaagaagcatttattattgggctgtcttctggaaaatcagaatacgagatctccacgcatctaggaaacccacaaacactagctaaaacccttatagcagactctattattcaaaactctaagaacaatcactcagtacagcatttctttcgcatcttcatgcgagtgataggcatcagtttctttaattttttctttacactttgtcccttcatactcattgctggcattttggtatcgctttttgcaacaagcataatgtcagttggcgcagcactttttgttgttcctcgttcattttttaatgcccttttcgtcttaggtggcggggtaattctttttcagatatcaattgatctaataaaggtgtttatcaaattctttttgaaatacattaactggaccgtcaagttagtaaggaggaagaaaatcgatgagaaaatggctttatagcgttgggttaacacttatgataattggtcttatcggaagcattttttttggtttttctggcctctggtactaacccctcagacagactaatcaaagtaaaagagatagctgttatttataattccaccattaaagaatacacaccaagctagcattctatcggcattagataacaaacattatgagcctattgtgttccactatgtccattttccgaataaaaacaggaatgttgtaagaatatcaaaatttaagttgtgaatccttacccgatatggtaattttgatttgtaataccaaataaaccctaattggaaggagagatttcaatgaaaaagaaggttcttgcttcaattgtattaggtataggtttactaggaggacaagctgcttttgctagtcagtcgaacgatgtcaatcacggggaagttaatttggacgaaacaagagatttaatgagcgccatgaagcttgataaatcaacaccgggcggtggtacgtggtatcatggcttcgaaaaaggccaagttcattccaattacaatcataagaaaaagactcacaaatcgagtgctgcggctggagcaagattctatgaaactcaatggaatacaaaaaatgaagggtatacttacgcttctgtatatgaagcccttttcggaaacaaggctttttgggatacaaaataaagaaaactatagcaaagtgatttttaaatttttcttccggtgtggtcaaacttgaatacaagtcagcaccggatttctttttatggaggctgcccaatgaagaaaacaatctacatattgttcattttggttttgctctcaatgaatatgtcaagctatcattacactcttaacaaacaaatctattacactttattctcaaataaagaagcattgataatcaattatacttcagaatttaaaagtgaggactttgtaaagagattggtcgccttctccaaagaaaacaaagtgaacatttctcaatacaatttcttggatgaaaagagcttaaacatctattctacaaaccctgaaaatgaaccatcaatacataacggcaataaacttgtgtcaaattttctaagaggccattcagagcagaagatgatcggcagcattacttttccgctttcgacatggaaaatcagatattttgatttcaatcaaataaagaatataggcataggaagcaaattttacatttcctctaaggatgataaggtattggaaaaagcacaaaatctttttgctgactatggtgaagtaagttatgaggacatcactgagaatactgcttttatgtttaacaaaactttgcttatgctagtgttgctctctatgctgattttgtttattggtgtcctttattttgtaattaaaaatcgcaaacggcttctgctgcaaaagttatgggggtattccaaagttaaaacactgctttcttacccagcaatgtttttgaagcctctaattataatcatattttgcggcgcaattattgtagctttgctaaccttttctttcagtttaaatgactggttggctgcatatcttagaatttacattagaaacgcggtgattggtgcgcttatcatgatggtatacaccatcatggttaccctcgtcttgtataacaacagcgacattagtggctcgatcaaaggcagcacaccgattaaaaaattccaatggttatctgtaggctttaaaattgttgtcacgatattgcttttcaatattgttgcgtcctcactttctaacttattcgatctcaaacagcagcttgataatcaatcgtactggaaaaagacccaaaacacttataagacaagctttgcaaataccgggatagactatagtgatttaaaattagacagggagaaaaatgttagagttcgcgcgttgtatcatcaattagagaagcataaaaatgcgttcgtcattgatgcacataactatgctgtactaaggaaagatggaaaaaaacctgtttatttttacaccttaaatacgacaaagaaaaatgaaatttactctccttctggacgaagcattacaatcagccctaattatttaaaggtgaatcccattatcggcgctaatggggaagccataagccaaaagcaattaagggctgattcaaatacattgaacctgcttgttccacaaaagtatgaaaaatataaagaaaaaataatagctgcatacagggatcactttttctttaaaaaagttgaattagataatatgtataacaaggagattaatcaacctgtaaacaccctcaaaaaagatgaattgaaaatcaacatcatttatactaaaaataggcaggagtatttcacctttaatagtgagtttggggatgccggcaataaaaataacattgttgatccaatagctgcaattttcacggacaacgttgattcatctgttataggggcttactcaacctcaagtttattcttttcagattcttcaaaaggcatggcgtatgaccgcatagttccttatttggagaagaccaatacgagagatctaattgattcatcaatttcggtttatcaagaactaagcgacggtatagcaagaattcagaatcaattcttgcagaatttaattggactaacaataacagttatcctgtccatcgcctttcttgttgcttatatttggtcgtattacagcgcaaatgcatatcggctgtaccttaaagagctttttggatattcatattgggccagaaataaaaatttaatcatcttttcccttttaaccaattgccttataggtttaggatgcagtatttattacaaaatcttcgaattaacaattttcatcgcgctgtttattgtaatcgagctgcttattctttattttctgagtgtctatttaaacaggagaaacatgaataggatcttaaaaggagatagaatatgattacactcaacaacatagcaaagacgtttgatgaaaaacctgttctttcgaatttctctcttcagataaaagaaaatgaatttgtttcaattgttggtaagagtggttcaggaaagacaacccttctaaatataataggccttcttgatactccacactcaggagatattgaaattttaggttttcgaaaccctaaatctaacgacgtgatgaaactacggagagagaacttagggtatatctttcaaaattacgtgcttatggacaacgaaacagtattaacaaacttactgctttctacggcatatgcaaaagatttcaagaaagaaaagttgacagaagctttagaaatggttgggcttgataaaagctttttaaagaaaaagatctatcagctgagtggtggagagcagcaacgtgtggccatcgcaagaattattttgaagccttgtgatattatcctggctgatgaacctacaggaaacttagacgaatctaacaaaaacattatcttgtctttattccatcagttaaaagatatggggaaaacaattatttgtgttactcacgatcaagaaattgccaatgggtctgacagagttattaatctttcataaggagaggtttaaattgaaacacattgtttttgcattatcagcaagtattctggtcgttattgccggagtggtacacagaatactctttagagtgtttggctttccatttgatcaggctatcttcttttggggcggattcgttgtagtttattttatcttagcgttgctagcttctctgctttttagaagtataggttcaaataacagaagtagcaggtatgaggcttaaaatcagcgatcaacttaggaacgtatttctaggagaatgaataaaacaaggagaccagccgaagatgccggtcttttttatatggagtggaattagccaggtaaaggatgatcatctatttgtacatctgaagtagcaaaaatatgagtatagacggcctgcgagggtttcgcggccgtcggccccgatacggcaccagcaggagagtatctgaaggcaaaaacaccccgcgtttacggggcgatcgggagtgtaccggcagcgccgcgccgtgaaatctccgcggcttatcgaagctgctcaaccgtttcatttttgaaacggtcggaatttgagccgctgctgtttgcttctcgtcctggtacggagccgaccaggcgccggcttgtagtctggtcaggacgggtcgccctggctgcagctgaaggagatgtgcggccgtcggccccgatacggcgccagcaggagagcatctgaaggcgaaaacgccacgcgtttacggagcgatcaggaatgcaccgatagcgcttccgccgtgaaatcttcgctgctcattgaggctgcggaggcgacaagattccggagccggccaggtaccgccttttttgtggccagggcgggcaacgggacgccctggctgtaaagagccggttcctttcagccggctctgtctctactatcatttaaaggtgaaaaaagattatggaaaaaactatcaagtaaactgccaaaacagtaaagcacaacaattccagctaccacgctcaaaattctaaatctccgatcagcactataccagcaagaaggaaccaatattaagcatacaaccattataattaatttagtcgtcaatttgatcaacctcttggttttcgtattgtcctgcaatgtacatattattattatcatcaatcaatatatggtagcaataacgaaattcttcatcaacataatatggtatctgagatggaatatcttttgatatattcaccatacctttttcggaatctatagattgtgttgctaaataatcggcatctgtcattcgttcaacaaaattttgatcgttcgtataaactcttaaaatagtgaattttttcgttttatcctttcgaaataagccattaattgatttatgcattttatgattactaaatgcaattgcagaaatataccacattggcacaaacataaaaggcagtaacattgcactgaaagtatagagatacatgtagcatgaaaagatcaaggtcactactgctagtatcgtgatccaatgcttatttaaaaaatctttagatagagttttcacatcatttaaaaataacttaatattcacatcttctccttcctagttcaccacacgccgtacaacaccgctaaaatgagcacgccaataggtattgttcatcttatctacctggacaccatgtgaactattatcatttaaaaacttcccatcccccaagtaaatacccacgtggccattagtcttataagtatcaaaaaagacaagatcaccgcgtttcatgtctttagcgtcaacttttttcccaaatttcacaagtgaatcagtaacaactgatgaaacatcaccaagattaacgccgccttgagcatacatccaatggacaaaagaagaacaatcaaacgaccttctgttgatatcaaattgatttcttcctccaccccaattgtaagggcttttcccaacaagctctaatcctgctttaatggccttttcagctgcttcaggacctttatcttttccaggattcatattgccaaaactaacttcttcagctttcccagatccatacaaatccatatattgaattacttcttggacataccagtcagcattattgtaagcaaaaatggctttttgaaagtcaccctttgctgccccactagcagcaagatagtttgccgcggaataaatagaatcttctaagtcccatatatcagccttgccatcaccatttgcatcgactccataaccaccatattttttaatcgttttcaaatcagacatttgactttttggaatattacctttcccaagtccactacaagaaggatgtccccatcccacccaagtacatggcataaactgaacagggccttgagcccccacatttgattccatctttttaattgatgaaaatcttgtttcaattctatggatagaagcaagtaatgtccaaggtaacttatatttttcagctgcctttttatatagtgggatatattctgctggtatttgattctcaccaatttctgatatattgatatcagaataatcactggtgggaactaattctttttgatttgttaaaactccaaaagcacccattaccaaaatgaccgccataacaattcccgaaattactaatatagctgcgctgatccctaaaccaatgtagatcttgattttcttttttttataattatatagagtgtttagagccttaacttggaaggttgacactaacatcactcacctttttttctcctgaaacatcctttattgtaacaaggtaccaatcttcttctgactttgatttaccctctttatcaaaaacctgcccttgcataactacgttccatcggacaagatctttattatcattagaaacgtcagtaatatatattttttcgggtttaactttataatgggtcaacgtccctctagttggatgttttttcaaagcattataaagctcttcggtcatataatcttttgcattttctatgttatcaataggattttcagcattaaaagcagcataccgtttcacaaattcttcagctgtttttttcgtttcttttttttcctcttcagaaagtctttcagcttgatctaaggatgatttatcctcttcaagactcatagctccttctgaggataaatcatcttcagcgggcttattaatgttattctgcttggctgatgcgccatcatctttggacacagattcatttgagctaaagaaaatagccagtccagatactaaaaacagagcgacaccgacagcaagagtaaccaactttttatgacgaacactcacccgcctcactctcctttattttcattcatcctttttcttatttggtctaactctcttgaatgaggattttgttgattagtttcattagaattagctgtctcgtctcttttaggcagctgaacaatattatcagcagaattgttttcacgcgttctttgctccatcgctttcattttagctttctctcgtgctacggtttgatattctcctgtttgcctacgttcactttctggttttaagttttcaggagtttgcggttgtttatggattcgccgtttttcttgtgcttcttgcctgcggattctttgtaaagcttcttctccttgaggtctcttttgcacagcggtattttcattctccccctgtcctggttgctgcttaattcgttccccatcagcctgtcttttctgcatttgattgattaaatgctgattcttgttaccagactgtttttcatctctgttttggcctttaccattctgatcagatagtttacctgctgacagttgttccaaatccttatgacttggttgttttttaatacgattatcttgtttattcttcttactattaacattttttaaaagtttatcagctgctttattatcagctttcttgtttagattagcagcagctttattgctatctgtcccctctgaagcttttattggggctttatctgatttattcaacctatcaatatttttttgcagtctattcggacttcctgatgatgtagttcttccagaggaatacaatccacctccaccaccagattcttgaatacgatctttcaccatttgttgttcttttgaattttgaaccatcttttgtgtaaattctcgtgctttttctaagttctgcttaacaatttgatatccccaaagtttagatgaaagcacaatcattgtaataacaactatagccactcccgtaacaatagataagtaattccagtttttatcctctgctaccttatacactatatttacaaggctgaacatcaatatgagtgaaaaagtaaatgctactgacattgcaagaaaatttaacaatttaagcacccattgacttgcaaacgatcgaaaagtaggcataatcgcagccattataatgaaaacacctattgaagcttgtattaagaaggcagcactgtatatttgaactagaaaagacactagtccagcaaaagccaaaattaatacggctggaacccaaatgaggaatgataatacagttctttgattggtatactcagctgaaaacatagtatcatccaaattttctttaataaatttcttccgttcgtcactttctggtttagtttttaaaagcgttcgcaacttttctttaccagcctctatatccttctgtgtaaagtcacttttactttttgcccccccaacaattgctaaattagtcgatccaaattccatcaacatataaggcttaacaatcaataaatcatgaagtaaatttcgaattctcgacaaaccataacgtgatgatgcagcgtcggtgtatcttggtgtatcttcacctttaactcgtccaccagaatcttggctatctaatgagtatgttgatgaacttaaaacagcgtttgatactgccaatcgtttatcattcataaaacccagaactgattcactattctgaacatacaaggtgaaaaaacctgataataacgcagcaattagaagtcctccaatagcatgtctaaattgtttttttgcagttgtatacactagccaagctgaagtcaaaatgagcataaaacccataaattggccaatcccatatggaccgccaatctctgcaataaggtcagcgatgtagccaatcatagaacctatcagatcaaaagtaaaagcttgctctataaaatataatcctgagttcacgactacagtatatccataccaaagacccgaaagaattgtttgttgaaacgccagaatactctctattacttcatccttgatattaaaggggtttaatgacttaatagcatctaaaattcctccctcatcctcatcctcagcatagatatctaaatcataattttcgatcggatactcattatatttaactaccggcgcagaagtatctggcaagtccgattctggtgataaatcatccataacattaggtttagctgatgcagcagaacaaggaataagcatcagtatacagaacattaataaaccgcagcggataagaagccgcctcttttttctcatttataccttctcccttattcatcttttttgacaggtgtcggttttaattcgtctttctccttctcagtcaaactgtcggagaaataatatttaggagtgattagctctccattctctttttctatacttccagcttttatagatccaaaaatttgttttgctaaatattgattcttaactttttccatcttcacagaagtaacttttttttcattgcttctcaaatcaaaaaacacaaacttataaatatattcactgcctggcttaatttcatattcgatagcagcatacttttcaacagatttttctttcacgttttcatagtcatctgggagcttactctttgcgtcctctaagctacttgatgttttaccaccgttgccccctatctccattgaatacatcttgtcataagcattttgattatcatatgtgacgtattctaaagcccttttacacgattctgtatcttcacatttttcttttccgcatccagacaatagaagaacccctagcaacattacagaagtaataatccttttcatgttgtatctcctttctaatagagggagagatattctcccctttaagcgttcaccatttcgctaaggtcttttgatgtgtcaaacgcattatatagatgatcctgcaatactctgaattgcattaatccaaccctattgtctaaatcgcgatggagacaccaaccggaagggagtgatgggagcaattgttcaatgcccgcagaatcatcaagttgcaaaaattcttggatagcttttatttcatctttattatcagccctgaagcaataagcagcaccaatttgtcccctaagttctttcggtatatctttaatgttttgtgtcatcaatgtgacaggagataacaaactgcgtccttctctaaatattttatcaatcaaacgtgttcctgctgcattattgaagaaattccaggcttcttctataacgatttctgttaaatcatttgggaacatgcgcaaaaacttaatcatataacttgaaagcccaaacaaaacagcaactgaaataatattttgttctgagtattcttcctctggcaagtctttaggtggaagtgcaagatctgctacttgtaaaatgttgaactgtttcgtagcatccaagtgattttctgaattggtcctttctgcaaagaagagccgagccagtgaaatagattcaaactgttccaaaatattggccaagtcttttgcaatttctctatcatcctcagtcaactctggatcacttttcactgcttctctaagctctgttttaacaaatcgaatggcaggctgttttctttgtgaaactcgtgtgcatgccttggctaccaacgtacttttcttaacatcttttctaatactgatgtttaataaatagttaataatttccctagcaacatctgaagcatcctgtcggttttcaaaaataagccacgggtcaagcttcccggcatcttcatcttttgttgtaaatgaaataaaatttaactccgtaccaagctcagtcaatttttcatcccagtgcaaaatgtctttcctttcactcttcggatctatgagcaacacttttgttccgtacaatgcaccttcataaattaaagagttcccagccattgattttccagcaccagtcttacctgatagaaccctaactaaagattgggttgatgtttgtgctgatgctgctcgaccaggccgcataaacacagaagtgccgctggcagtcctaccgatgtaacttccgtaatcatcacctaattcttgacgattcccaaaaaagcttgatgtaacagcgttaacatccacatcctgtataaattccgtaacgtacctacgtgatccaggaaggcactccataagacttctcaactgtaaaccaaatgtattttgaagctttatcccgcctactgagctatattcttctattaagcttgtcacattaacatctagttgttctctactgcttgcgcttaccacaaagatagcgctcattaaaaagctgccttctctctgcttttcttcctctgcaatagtctgattcgctgttgcaattccatcatatacattagaaccagcatcttctccaaattgagctaaatgattagcctggtcctccaaattcgattttttcaaacgcaacttactgatccttttatcaacattttgatagctcattttcagactaacaccaacactaaactctaaatgtcttaatggttcaagccatctcgtttcaggaaaatatacaatatcgtccattgttgtcatatgcagaaaagaaatataggttttttgattatttccgtaagcatccgtttgattaagtacaaggtggagacgatctttggaattttcaataccggtcatttgcaatttcataacttcttcttctgtttgaacacgtgcaactacttcgccaccttttccataaaccggtgtatacttctccgcccaccctttattatcaggcagatgtctaatacctatattaaaaatccaaggcaacagttcagacatttcctctgtagaaagctttttatatgacatttcaaagctatctaaaatgctctgtactttcctagcactccttcttgttttttctaaaagttcctgtcctaaataaactgagtgttgcccccttaaccgatcagttatatttgacagatactctttaatatttgcaaatatctcactataactcatatcttctacattttgatcattcatggtatcttggccgagctctatgcctacataaaatttcattttattttcttctgaacctaattcgtcactgtcctgcaagtagtcaaaaatagcttttgtatgctcaattccaactgattttaaattccctcgaaactcccgtgtgtatctttcataaacatcgtttaaagattgacggacgggaaccacaaggcaatgaagctctcttttcatttctttaaaaagacgtttcaattggttgaaacgtcctatcaattgagcttcagaatcaaagctggtatgaaatcctttgaattctacccataattgttgcctcttatcttttgtataaatgacgttttcgcacacggctagaatatcactctcgtatttcaatatttttcacctctttcggatatttgaaatgtcgcttcattctgattttttgttcgaatcgaatttctttatcttgttcaacctcttcaaatcttatcatttcattaggctcatatttggttttccatttgatgatccagtaacgaatcatgctcatgctttccctctgttgcattcccaatttatagcctaatgcaagtgggacaataataattaatatcaagaaacgggcaatcgctggaacaaacggaaaaagccaattagaaattaaatacgctggaatacccattaatagaaagacaaacgctaaaattgcctgcgtagtcgtggcagagaacggaagagatatccctccgtcactcgatcctgctagcccacgaatcacatttggaattttgaacacagctgtggtacatcttcctcttatcatggtgatagacacctcccacattacattagacccaagaatcgaagaatggactcccctaagctcttaatattgctaacaccgtaaacaaaaaccgatagtatagctaacactaccaaagcaccgaatgcagctctaaattttttaaaggcaagcaacataactagaattgcaagcgctacccatccgtaaatggtttgaatagtcccttgtacattgctatcccccttactttgaattccatcaatattaacagcgcccaatataaaatctaaatgacctgagttttgaacataatcaaaaaatactgaaagcatataaattcctcctaatatattaagattttcttttattcaactttggcagataggtttctcatctctacaatttcatatttatccgccccctcatgatttaaaataaattcatatccataaagactttgaatatctgaaacagattgttttaattttacatcgctacggacaatatattgttttttcttttctccaggatatactttcaaatcttcgattctcacaaactcataagagccctctagtgactgcgcatcattggaatttttaaagaaaaatttcatatcatctgctctatctttattgacataagagttaaaaaacgattctaaaaatgttcttacattattcgtagcagctttatcttctgtaagatcagcataatagttatcaaccgttttcttctcagattcctttggaacatacggttgcggcagatcaattactgtatatccagtatcatctgcgtgaacacgtatcacataatatagttttcctgatttttcatctgtatcagttacctttttctcgacctctacttcttttttctttccttttttatctttctttttctcctttactttttcaattcgttctgttttaattacagacttaatatctgcgtctacataaacgtcagccgttgttttagtaatccctttcacttccatgatcctacttcctgttaaagtttgttctccttgcacggaggtataatctatccctccatccgggtccaaaccattagctaaatattttttcaatctgtcttgacgttttttctgattgtcttctcctggttggatatcaaagtaatcattaagaaaattctgaacgaaataagtaataccaggtctttcagcataatcatctttcactttattttcttcagcagttgcagcatctactttttcttccatactgtgaatgactccattatgccgaaatgcattaaaagaccctaagagcacaatcacaagtaataaaaccaaacctatattcattgcgcgctgaaaagtggacggctttagagctacccttcgtgccctttttacttggtatgctttttctttttggtctttttttaaggcagccggatcataaatttttttttcagcttttttcgttttccattcactcactagatttttgaaactttttttgtccttttttggtttttctgaagaagagcttttctttttgccccatttattcaaattacttcacctcttctttcctgaaaatataaatattgcgcaagcgattataattaaagctccaagcaagccatattttgcgaccaattgagaataaaaatgggagccctgtactttgacagtctcccaaacatctctggtccctggaaattgagtgagaatgaaacttcccacaaaacaaattcctgcaatatatatgagcgctttaaaaattccgcgaaacatatacactgagacctccctataattctttttttatcattggatcatcactcaaaatgtgatgatatatcggatcaaatgcatgccgttcaacatctgctttacttgcgactaatattggggctttaatgtccatgttatgaatactcaaaatatcatttattgttttcctagtattaggttcattcccaccaataaacaggactctccagtctgaaataggagcttcaaaccccacatgcatatcatagtcttttaaaatcttcttgtctctattcaaaaaatcattatatcggatcactttttttattgtattttgcctttttgcaacactacgttccagctccataaaaagcccaatgttatcattagaccctttcccgccaaaaaccaatattccatcaggctttattacatccgttttatcatttgtatattgccaggttgctctagcctctggtatccactctttaacttctaatccaatttgttcagcttgtttagtgtatttcataacaattcggttcagcattaattgatgttgataccaaggtggcaccctttgggaccacctcggattccatttaacaacaccttgcaattgctcaacattttgcaaaccaaaatcagtaagagtgtagatgttagccggcctggacatcccatcaatcgggacggtgaaacttactaaatatcccacatcttttaaccttaataacctttgagttagggttttttttgtagggtagtctgtcatgatatattgatgtataaaatcagtgtccatatatatgaattgatgaagggacagaagcaagtttttgtcactttccgataaaacggcatatcttttttgcttcatttttttcccctttttctttttttcagggattgtatcaggttgtgtagtaataatgtccaactcaaatcaccttttcttctttattcctccttttgatcatcggcttttgccttcatcctttgtaatattgatccagtagagaaattttgattctctgtttcaccttcgattttgggtcttctctcttctgtcttatgctctttctgattatttaattgtttagtatcttccttcttttgaagtgtaagaggaatcgtttctgcctcagtttccatctgttcctcatgaattttttttgttctcataagatgcaaaggggtttctggttgtttagtaataggagccttcaatttccgcggactttcttttcttttttgcggaacatactcttcacccttcagataagcttttataatcaaatcaatttccgagtaatggaaaccattttgtgaagaaagctcctttgccttttctaatgtccacgcattggctgcggcaacctcgtcctctcttctatagttagcaaccgttccatcaggtaaataacgatccaaaggaggtacttccactaagcaggtcactgtttgatcgacaccatctatgttatcttgagtgcgaactacagcaactcgatcgggaagtgattgtaaaaaactttctgagtagataggttgattggactcttttgccctgaaaaacggtgtagttacctttgcatcatcttgtccttgtcgacaaacaaagaaattaccttgaacatttgtcattgctttttgcaaatcatcgggaaggtctttaatagattgggttgcaattccggctgaaagtcctttcttcctcatttctcgcacaatataaggaaatattgaagctttaacctttgctgcttcatcaacagttaattgatgcaacaaaggtcgtccaggtctttgttctgctacccgatagaatagatatgttaaattacttccaattaagctgatttcttgctcccccataccactaaaatcaaagaaaataaaatgtccttcatccatccacttacggactggaaaagcaaactctttttgaccaaacatccgtctaaataggtcatttgaagtgaaaatatccaaacgattaaaaagaggaatccgacttaactcaattaagtcaggggcttcaaaattccaaaaatcaactaaatcatatgcttctggaactttcgaaagcctagatacaacacgcatccggaacacctcgtcattaatcagctgtttcacacctaagatggtatgtgtttcatctggatcaatcacaagggtttttatacaatttcgaagcagcctttcagcttgaggagcaacagaaaagttttctctaatgatccgcataacaatatcagtgacaaactcagctgattctccttccatgcgatgaagcagattcattgcaggaggataatcagtatttttgaatgaaacccaatgcaccttactccaatcaatttcttttccatccagctccgctttgcaaatttggttaagtaaaacaagagcagtttctatggccggatcaacaaaagaaaaacctggccccttcccgttagcaataaatccatcaataaaacttttcaaaacagcattaattaatgttgacttcccagatccgtttaaaccagttaaaagccaatgtttccccaatacatccggcgaaaccttcacctctcgatttttcacaaaaggatggtattgataaccaaacgtaattccttcaggactgcttaacacattagcagggagaagttcagttcctttccccgcatgcgcaataagtttcgacaaactcttcatatgatcacttttaaaattcggcatatgaatgaggttagccaactcgctgcctgtccacaccatacgatacggcttatttgtaggaaaccattgtactgatcgttttagctttttataacgtaattcgttcgtgtcattagcaatagaacttatagtgtttccaacatttttgatgattcgaactcctggataatgttctgttgccatagaaacagtgcaatcaaaagcaacctcattacctgagaaacgatgttttaaactatttagttcttctttttcaaaactgctttgatcacttgccttacgatcccctttgatttcctcttctaattttagaatgccttttcttaaacgccatccgtcattcgggctaaaagcgacttgtacccaagtctcattttccattgtagacagaattccagatagctgatcagaacgataccgccttaatgggagagatttcttcaaagagttattccgtagtttcaatcttcctcctaccgcttttttactcggtattggcaaatcctctacgtcaaaaaattgcattctaccataaacacttttaaagtttgctttcaaagtctctaattgcgaactctcagcaccaagataaaagttgtatcccgcaccctcttctggagaactgcgataaataacaaatgagtaccactcacgacctaaaaataaccgctcaagaatttttcgtttcgaaccgtgaatacgtctcattaaatttgataagtcttctgcggagactccatcatcagcatgcgggagtatatgaacatattcataacttttttgaatccttaacacatagaaaattttcctcaaaaccataagtaccgcggcaagaatcaaaaagtaaaaaacaaaacgttggattgtcttcaaccagtaatgtaaaacatcctctgaaattgaaagcgatgttaataaaacatcccacttccaatatccaaagaaaatcccaatcaaaattactacagagattaatcgtaaagggtgatctaaaaaatggtccaaaacatcatccaatatattcctttgtcttttctgctgattaggcatcaaaaaacattgcctccttacatcagaagaaacaaaagcaaaagagagatattcaattatcaaagatcagatccatataaaatagctctgtcttgatgtcccgatttaagactggataggtgtaagtcttgatgttgctgtcttgattttgggtagttaggtcttggtgtttgcagctctatatggagtaaagatcagcatacaattcagtggatttcaaaaagaaggaggtaggggtttgattgcccggccgtcctgctcatatattgattaaaatccgaattgcagaagttcttttttcacttccagcagctgtacatattaaaaagggttttaatatgtactctgcaggaagagaatctttaaaagtatctgtaactacatgttacacccaaaacacttttgtatcaacgtctcaagcctatttttatcctatgtttatggtattctattcaaaagggtactttcttaccatgtccttcttatatccttcgcaaaaacatagtataaaactcacattaatcttcaagtgttgtattatatattttgatcgttttatcagggcgatcaggttgtgtagttggccaaaattctcttgtgggattttggccgttttaatcaaaaatcatgtttaaaatgagaagaaaaacgcttaaacaatcctaacttcccactcgatttttttcgcactctcgcacttatctctaattcaatttcttccagaaattcctttattttctctatgtcgtgacagtcattttcacgtaactcatcgagatatttttgtctcaaacagagcaatttgatctcgctcaccttgccgatatccaatacaaattcagtaatctccgaagcacggtaattagacaacagacctttcacagttccaaaaagatactttaggaatgagtcttgaccagaatatcctcctacagtgggggaacccttctcgccaacagttaaagaaatagcctcaatcaccagattcatatagtcctggacaacagcgatagacgaaaaagcaatattaaacttcttgaatgctagttgaacgcggccccaggcggcaaaaatgaaacggccatcggtaaaaccgcggttaaataaagcgctgctaaatcgtcctggaacattaccaggaacaggagcgcggccaggagaggaaatcgtaggtgaaacgtacctggtaccatccagactagaggataatgtagctgtaggcacagtaccaacaagagcctgcccacccacgcccttcccactgttattagagagtaggacatttatttggccacagaaggattcagcagcctttttagatctgatcgtattaaattgttttgtagtctgctcagaagcgtttaaatggctctcagagcttcttaaatcatcggcaggtgtttttgtaggcgaactgtcatctgaagctaacgtaatgagtgtgaaacctccacgccctttttttgtttccaccatcaataagccctttaaaatcatgtttttaaggactttgcagaatgtactgaatggtttttttagcgtggcagcaattgacctttgtgagccgataagcgcctcgttttcctttaaataatcaacaatgtcttgctcatgttcactaaaatggcttctaactcgttcagagcggggttttgcaaagcggctgttccaatatatcttctctgggtatgcttcacctgtgaggtattcagctgcctttctgatgaaactatagcttacataacgattctcagagcgataaacagatttaaccttacctaatagctctctttggctcattttcttcttattgttttcattccagcttaaaaggcgtacacgtgcctctctctgcgtcatacctgcgattttataagcacatgccaaactaaatgacacccgatctctcatgtcatcaaaaccgccattttgtacgtctctaaaggcttttgactgcattaaagcgccattgtatgtagaaaaattgactgctcctttaaattgttcccctctctccgcgaatttgcgttcacattcaagggcataccaatctgtaagactgctagaatgcacgctatgaccctcatacacaacattatccggattaggcgctctaaagtagtgctccgcaccgattgcatccaaatcgcctcctatagcttcagcaatgcatctttgaatacggccataaacttttacagccttcctggttgctctaaaaggagttttatagacccatagcaagtgaaaaccaccacttggactttgtagaattgttgttggatacggcaatccagcagcggaaacacggtcgagaacgtccggaagtaaaagaccggcattatcagtattctcttgaccttttacatcaatttcaacacacatagcattcaaccaccggaggttttgccgcgttttccggtcattcctataaaatgtgttatatgtaatgtgcgttatattgctcttgtttaagtgttttttcaaagtttcatatgtacgaacaccaaactcttgagagaaattcccctccggcacaagaaaagcaaagccataatcctttgagaatttattttgatagtcatttttacgagatcgagccttaccttttggcttctctgtcatttgccctctaaagatcgcttctacaggcgttgggattgacaacagcttggcccttttttcggcagctttatattgtttcatatcatctttgtacatgttcaacgtataatcagctaacagggaagtgctcatgatctatacctccatttttccggcaaacaaaaagagccgttagtaagcggattcgctcaccaacggctcatatttagccaacaattttgaagatacagataggcatacgcacatgacgatttctcgaaatgcgcgaaaaaatttgcagatattttgaagtctaaatatcttgcaacttttcctgcatactgatattataggtacatgagtaatacctataaatcaatatgtatcttcaagctcgttggtttggacgccttgggagcttgaatccgaaaggtcagtgttggtagcactgatcttttttcttgcttgttttattttcagaatattcagatttaatcataatcctattttttgtttgtttatgtctcttaatctcagataatttcgatatgttaataatgactatacaagattttttttcctacgtctaccctagaaccgaccagtgaatttcatactagataaacacattgattaaaatgatatcaatttggttatcgtcatgatatcattttgatatcattttatcaaataaaaagagcttcccaaatacatttttaaatttgatatcatttagatatcatttttgatatcattcttaccattaactcttgcatttttaaacaagttgttttaagattttattaagttgatatcatttagatatcatttcaatcaataaaaaaagtcgaaaaaagttgaaaaatttcctaaacaaaatttaaaattggtcgaaaggtggttgcatttttcaatgaataacctaattacggaaaaagataataatattgtaagtgtgccgaacgtagaactagagatagccgcagacttgggcaactccaaattgaagatgatttttgatcgagatgaaaagtctattctccgagaaccatctgttatgagaagaatcattaaacaaccggaaattacagaaacaaatgaaaaaaagcttatggccaatatttttgatcaattgttcgcaaacgtttctagtccttctataaaaagagccggctctttcatggtcggaaagagggcattaacgtcaacaggtggaactcttcaaaacatgaatataaatcttggcaaaaagtataaagaggatctccccatcattaacttgctaacatatattgctgctaaagcaaccaaggatcattacgatgcaaattcagtaattccaagtgctttacatgtccattgcgatctatctactgcgataccggcttccgaatactcagttgaaaaagcggggatacttgaaggacgtttcaaaaaaggtgtccacactgtagtgctttatattggtgataaacaagtaacagtgcaaatctccttcaaatttgtaaaagtaacaagagaaggggttccatcgttatatgctatattggaaggccctaatgaatattttgaagaattcaatgagatataccaaaaagaaaatggaaagaaaatagatgggaatttcttcgcgaaaaaaaagattctccatgctgatattggcgatggaacaagtgagtatatttatactgaaggcatgaaacctatttcagatgcatgtactggggcaaggagaggtgtagggcatgcactcgaagaagcctctgaactgttaaaagaccaatttaatggaaatgtagaattaaatagacaacaacttgcggaaacactacgtaataagacggataaatattatattgaggcaagaaattgtatggatgaagcaataatttcacaagcaacgctaatccatgaggacattcaagagagatatatcagatacacatcttcacaagctgaaatatttgctgtttatggtggtggtagtgttacctttaaagacgagcttcataaggaattgaaggaatttgctgacgaagtgaaagcacaaatactatggattcccgaaaaacatgcagcggatatgaatgttcttggtcttaacataatgaataagcgtatcttcttaaaaacaaagaagaaattcaaaacagaaactaaaaaaaattagaggtatgatcctatgggaaaatataaagagccgcggaaaagttatctgtatcgaataaaagaagaggatcgagagcctgtaaatgagtggttagagagtcaatccaatatcgctgaatctttgactgttttgataagggcctccattgatcggttcggttctgaagctgatattacgtcttatgaaatcagaaaaaaaatcacgctagatacagaacgcttactgcatggagatttaccaggattaaattataattccaatatcggatcgcagactgaagaaacaccggctgaaacacaagaaacggaagcaccgaagaaaaccgtatctaatcttaatattgatgatgatgacgtaccagaactggattatgataatgcagtagatcctaatgatttttaatctttgcgaaaaagcctctttcatagaggctttttatacgaagaaattaagccactctaaactgaatatacacaaaaggaaacgataattgcactacaatcgccctcagcaacacactattttattccatcacattaaatatgattttatgttattatttcttttgagaccttggtctcaaaagaaatacaaagggggagttttctttatgaacgaagtatcgccaacagatcagcaaataacaattgaagatgtcacgtctgaactacataaagcctttgatatattcaacaatcatttttttgatggaatactccctgttccagctattacaatccaaacaaataagaataacaggaatgcaatgggatggtgttctactgtacctaactggggaacaaaagatggaaaacaccaaatgtatgaattgaatttggctgctgaatttctcgacttagatttctttgaaaccatggacactttgcttcatgagatggtccacttataccacaaagtaaaaggcattaaagacactagccgaaaaggcgaatatcacaacaaaatatttagagataaggtacttgaattagggtttgaatattcagaaaataaaccgcatccaagaatgggctggaccttcgctcgtataggtccggctttgaaagagcgtatatcaaaaatggatatcaaccagaaaatcttttctatatcaaaacgcggctatatgtattttcagttattagcagacggaaaaactcctgaacaagctgctcaaatctgcgaatcatcagagcagcaaccggctcttttaagaacaaaatctaaatctcataaatggttgtgccccaattgcgaagtaagagttatttcatataaggaaaatgtcaatattatatgtggagactgtaatgaaaccttagttaaacggtaatacacccctcctttataaatgacttatattccgttcagcactagagcatattgggtttaaatatgctctttttcagctggtctatatttattttgtgcaattgacggctaatccatcctgccggcgcctggtcggctccggaatccggttgcccccgcagcttcgatgagccgcagagatttcgcgacgcggcgctgccggtgctttcccgatcgccccgtaaacgcggggcgttttcaccttcagacgttctcctgcaggcgccgtatcggaaccgacggccgcggatctccttcagctgctagggcggcccgttgcctgacctggacacaaaaagccggcacctggccggctccggaatccggctgcctcacagcttcaataagccgcggagatttcacgacgcggcgccctgctgatgctctcccgatcgccccgtaaacgcggggggtttttgccttcagatactctcctgccggcgccgcatcggggccggcggccgcggatctccttcagcagccaggcattccgtcctggctatgacaaaaaagccggcacccggccggctcccgaatccggttgcccgcagcttcgatgagacgcggagatttcacgacgcggcgctgccggtacactcccgatcgcttcgtaaacgcggggcgttctcgccttagatgctctcctgccggcgccgcatcggaaccgacagccgcggatctccttcagcagccagggcggcccgtttcctgcctggacacaaaaaagccggcacccggccggctcccgaatccggctgcccccgcagcttcgatgaaccgcggagatttcacggcgcggcgctgccagtgctttcccaatcgcttcgtaaacgcggggcgttttcgccttctatgctctcctgcaggcgccatatcgggaccggcggccgcgtatctcgtttataagtattgcttcagaaaattagaagcgtagtaaggaaatttgcgttccgtgacctctaaaaaccgccggatcattacataatcatcgctgacatgctgcgtcagcagttcataccaccactccgtttcatatctcgcaatcattccgacattgtacaggaccaaataatgaataatcatttccggaagatgcaggaagtgatcgcgctgagagggaatataatattgattattctctaagtgaaacaataaatttggtgaagaccaaggttccctgtctatcggagcggcctcaaaaaccaaattcttatggtctttcctgacaaaagaccaattcaagtgatgactgatgtattctgcaaagcgggtgtcagacatattgtaatgaatcaccgcatgttcaggcactgaaataaggttatctttcagctctactttggtcagccaattctttttctcttggaaatggaatacagcatgcaattcaggaatggctgtcagcaattttttcattgtataccgttcttcctcaagaccggctattccgaataagtgtttcatcacatgaatacataaaccattgcgctgcaccttcacttcatcatccctaaaagagtaattttgctttttgcgttttcgggcagtcacgccatgtgcgagtactgaagcgtggcttggatagcttggatctgtggtcagaagacaggctttcagcaattgtgacatcccgtaaaacaacagaataggcttaatttctaaaggagaaagggatgcctgcttataaaaggactcggcgtgtttgatgaagaatatgaagcgctcactgtttttaaacgcataccgttttggttcttccattcctctttctgtatagactttatttagaaatttctgggaagattctacagaataaaataatgataactctttccattcaaggtctctcatatgtatttttaaaccctttcctttatctaaatatttcaactctttttcgcttccttgacatgccgttttctagttgataatctacatataatattttgccgaaaagagggggatttactaatgtgggaaagtaaattttcaaaagaaggcttaacgttcgatgatgtactgctcgtaccggctcaatcagacgtacttccgcgtgatgtggatttgtctgttgaactgacaaaaacgttaaagcttaatattcctgtcatcagtgcaggaatggatacagtaacagaatcagcaatggcgattgcgatggccagacaaggcggcttgggcattattcataaaaacatgtccatcgaacagcaggctgaacatgttgacaaagtcaaacgttctgaacggggcgttattacaaatcccttctttttaacacctgatcatcaagtattcgatgcggagcatttgatggggaaatacagaatttccggtgttccgatcgtagataataaagacgatcaaaagctggtcggtatcattacaaaccgcgatcttcgctttatctctgattattcaatgaaaatcagtgatgttatgacaaaagaagagctggttacggctcctgtgggaaccacattagacgaagcggaaaaaatcttgcagaagcataaaattgaaaaacttccattagtggatgaccaaaacaaattaaaaggtcttatcacgatcaaagatattgaaaaggttatcgaattcccgaattcatctaaagatgaacacggacgcctgatcgtcggcgctgcggtaggcgtgacaggtgatacaatgactcgtgtcagcaagcttgttgaagcgaatgtcgacgttatcgtggttgatacggctcacggacattccagaggcgtactgaacacagttgcgaaaatccgtgagacatatcctgaattgaacattatcgcaggaaatgttgctacggctgaagcgacaaaggctttgattgaagccggagcaaacattgtaaaagtgggaatcggacctggatctatctgtacgacacgcgtcgttgcaggcgtaggtgtaccgcaaatcactgcgatttatgattgtgccactgaagcgagaaaacacggcgcaacaattatcgcggacggcggtattaaattctccggagatattacgaaagcattggcatccggcggacatgctgtcatgcttggaagcctgcttgccggtacttcagaaagcccgggcgaaactgaaatctatcaaggcagaagatttaaagtgtatcgcggtatgggttctgtcgctgccatggaaaaaggcagtaaagaccgatatttccaagaagaaaataagaaattcgtccctgaaggtatcgaaggacggactccgtacaaaggtcctgtagaagaaacagtgtatcagcttgtcggcggtcttcgttcaggtatgggatattgcggttcaaaagacttgcgcgctttaagagaagaagctcaatttatccgtatgacaggagcaggtcttcgcgaaagccatccgcatgatgtccaaatcacgaaggaatcaccaaactacacaatctcataattgttacaaataaaaaacatttgacagggtcgctgactctgtctattttttttatatcgagtgtgataaaatttataatgttgtgttttgaatttgaatatgtccttaacggcttaattatagatttaaaatgaatgacggaggtcgtaagattgaacatcacgaaatggaaacagatgttggtgtcattagtggtactggcactgaccgcaacttgctttgttccgatgtctaaagcggaagcagccggcaatgacccgattgatgtcaatgcatcagctgcgataatgattgaggcttcatcggggaaaattttatacagtaaaaatgcagacaaaagattgccgattgccagcatgacaaaaatgatgactgaatatctgcttctggaagccattaaagaaggaaaagtgaaatgggaccaaacgtatactcctgatgattatgtctatgaaatctctcaagacaacagtttatcaaacgtccctctccggaaagacggcaaatacacagtcaaagaactgtaccaagctatggcgatttactctgctaacggagccgcgatcgctgttgccgaaattcttgccggaactgaaacaaaatttgtcgccaaaatgaatgcgaaagccaaagaactaggcatgacaaactatgactttaaaaattccaccggtcttgtgaatgaagaccttcacggcaaacagccgcaaggggaaggcgttaaagaagagagtgaagtttctgctaaagacatggcgcttcttgcagaccgcctgatcactgattatccggaagttctgaaaacaacaagcattgctaagacgaaattcagagcgggcacagatgatgaaatggacatgccgaactggaacttcatgttaaaaggccttgtttctgaatatcccggcgttgacggcttaaaaacaggttctactgattctgcgggatcttgttttacaagcaccgcacagcggaacggaatgcgggtcatcaccgttgtattaaacgcaaaaggcaacctgcataccggacgttttgatgaaaccaaaaaaatgctcgattacgcatttaacagcaatttctcaatgaaagatctttaccctgaaggctctcaagtaaaagggcacaaaacgattgacgttgacaaagggaaagacaagcaagtcgatattgttactgataaggcactttctattcctgtgaaaagcggggatgaaaagaactataaagctgaagtgactttagataaaaaagaaatcacggctcctgtgaaaaaagggacgaaagtcggaacgctgacagttacatacaaaggcagtgacaaagactacggcttcctcaaatccaaagagttcagcgtgaatcttgtaacgaaaaatgatgtagataaagcaaactggtttgttcagatgatgcgcggcatcggaggcttcttctccggaatctggaacagtgccgttgatacggtaacaggctggttttaagaaataagaaagagctctgatgaaagttagggctcttttgcttaatatactgaaaaaaccaaattgttagtaaaaaaatgatatctatctctttcatctcgctgtaaaatgagaatatccatatgaaatattgtatttctgggatacaataagagatagaaattatctaatcatacattgactagggggaccaaataatggctcaaacaggtactgaccgtgtaaaacgcggaatggcggaaatgcaaaaaggcggcgtcatcatggacgttgtaaatgctgaacaagcgaagattgccgaagaggcgggagctgttgccgtaatggcgttagaacgtgttccggctgatattcgcgctgccggcggtgttgcccgcatggctgacccgacgatcgttgaagaagtaatgaatgctgtatccattcccgtaatggcaaaagcgcgtatcggacatatcgttgaagcgcgtgtccttgaagcaatgggagtagattatatcgatgaaagtgaagtcctgactcctgctgacgaagaatttcatttaaataaaaatgaatatactgttccgttcgtatgtggatgccgtgatcttggcgaagcaacgcgccgtatcgctgaaggagcgtccatgcttcgtacaaaaggcgaaccgggaacaggaaacattgtggaagctgtccgccatatgagaaaagtaaacgcgcaagtgcgcaaagttgtggcgatgagcaatgatgagctgatgactgaagctaaaaacctcggtgctccttatgaactgcttcttcaaattaagcgtgacggcaaattgcctgttgtcaactttgctgccggcggagtggcgacgcctgctgatgcggcattgatgatgcagcttggcgctgatggcgtatttgtcggttcaggtattttcaaatcggacaatcctgctaaattcgctaaagcaattgttgaagcaacgactcactacacagattacaaactgattgctgagctttctaaagaattgggcacagcaatgaaaggaatcgaaatctcaaatctattgccggaacagcgtatgcaagaacgcggctggtaaaaccataggagagctggaagcatgttaacaattggtgtacttggacttcaaggagcagtaagagaacatattcgttcaattgaagcatgtggttcaaaaggtgtcgtgattaagcgtcctgaacagctgaatgacatcgacggcttaatcctgccgggcggggaaagcacgactatgcggcgtttaatggatacgtatcattttatggagccgcttcgcgagtttgccgcccagggaaaaccgatgttcggcacatgcgccggtctgattatcttagccaaagagattgcgggaacggataatgctcatttagggctgttaaacgttgttgtcgagcgtaattcttttggccgtcaggtcgacagctttgaggctgatctaacgattaaaggccttgatgagccgtttactggtgtatttattcgcgcgccgcatattttagaagccggagaagatgttgaagtgctttgtgaacataacggacgcatcgtggctgcaaaacaaggccatttcctcggctgctcgttccatcctgaattgacggatgatcaccgagtgacagagctgtttgtgaaaatggcggaaaagcataagcaggaaacagctgtataaaacagttgaaaaccgctgatacttatagtacattataaacacaaataaagatcgaaaagcgttgacaggaagcagtaggaagcccctctttcaaagagagccgatgggtggtgcgaatcggtgaaagatgctctccgaatccgtccttgagcgaaatgctgaaaacaagtaggcatttacgggaaaaccgttatgggttaaagcgggaagcaagtgtgagcttgttttcaatcagggtggcaacgcgagagctctcgtcccttttaggggatgagggctcttttttattttcgataaaaacagataggagttgttaggcatgattgacacgaaggtgctgagagccaattttcaagaagtaaaagcgaagctcattccaaaaggcgaagacttatctgactttgataagtttgaagagcttgatgaaaaaagaagagagcttatcgggaaagtagaagagctgaagggaaaacgcaatgaagtttctcagcaggtcgccgttttgaagcgggagaaaaaagacgctgatcatattattaaagagatgcgtgaagtaggcgaagaaattaagaagcttgatgaagagcttcgcacggttgaaacgacactcgaaaccatccttctgtctattccgaacatcccgcacgattcagtgcctgtcggggaaacagaagatgataacattgaaattcgcaagtggggagaggcaccggcattttcttatgagccgaaaccgcattgggatatcgctgaccacctgaacattcttgattttgaacgcgcttcaaaagtaacgggaagccggtttgtgttttataaaggattaggggcccgtctcgaacgcgcactctacaactttatgctcgatcttcacgttgacgaatatcattacacggaagtcattcctccttatatggtaaaccgtacgagcatgacaggtacggggcagcttcctaaatttgaagaggatgcttttaaaatcagggaagaggattatttcttaattccgacggcggaagtgccgattacaaatatgcatcgcgatgaaatcttatccgatgatgcattgccgatcaattatgcggcgttcagcgcttgcttccgttcagaagcgggatctgccggccgtgatacacgcggtttgatccgccagcatcaattcaacaaggttgagcttgtgaaattcgtgaagccggaagattcttatgaggagcttgagaaattgacaaatcaagctgagcgggtgcttcagctgctcgaacttccgtatcgtgtcatgagcatgtgtaccggtgatctgggctttacagctgcgaaaaagtacgatattgaggtatggattccaagccaagacacataccgtgaaatttcttcttgcagcaactttgaagcgttccaggcaagacgagcaaacattcgattcagacgcgaagcgaaaggcaagcctgagcatgtgcatacgttaaacggttcaggtctggcagtcggcagaacagtagctgccatcttggaaaactaccagcaggaagacggaagtgtcgtcattccggaagtgcttcgtccttatatgggaaataaagaagtcatcaaaccgtaaaaggtgcgccctagaggcgcgccttttttgctgtttggtataaagcggcgacattccgggctgtgctttcaaggttaaaacggcctgattctaaagcatcttcaagacttacagcgccaggcacgatagaaaacacagcggtgattcctctgttgtatacatgttcaaagtctttgcctaaggaacccgccaatgcgataacgggaatttcttgagcggatgcgcgtgcggcgattcccgcgggggttttgccgaatatcgtttgtccgtcaatctgtccctctccggtgattacaaggtcagcgccttttatctgatctgaaaaggacagtgtatctaatacaacgtcgatacctctttgaagttctgcttgtaagaaggcaatcagtcctgcccctaaacctcctgcggcacccgcaccttttacagaatccgcttcaatatcgtgttgccgtctcaatacatcagcgaaatggcgcaaattgctatccaataccatttttgtctcctcggacgcccctttttgcgggccaaagacatatgacgccccattttcgccggtcaggggattttcgacatcgcaggcggcacgaatacgaatgtgcttcaggtcaggggagagaccgcttatatcaatagaagccagggtgtgcaaagagcctccgccgtcaggtatctcctgaccttcctcatttaagaaacgcacaccgagcgcactcgccattcctgtcccggcgtcattggtggcgcttcccccaagaccgattatgatctcactcgccccgcgggaagctgcatctgctatcagttcacccgttcctcttgtggtcgtgttcaacggatctctgagatgacggggaacgagatggagtcccgaagcttccgccatttcaatgactgccgtgcgcccgtctcccagaagtccgtatgcggcaattaccggtgttcccagcgggccggtcacagtttttttgataatgcttccgccggtggcatccgttaaagcctgaacggttccttctccgccgtcagccacgggtatcttgatatattccgcgtcagggaagaccgctttgaatcctttctcgatgctgtcggcggcttcttttgatgtcatgctttctttaaaagaatccggtgcaattatgactttcattgtgttctccacctttatgagcaggtttatctatttcaatctattcttggttttcactgtttttcctgcccgtatgacatactgaggttgatttggagacaagacttttgtatgatagtaaagctgacggaaaagccgtttaagaaaagaaataaaaaaatatgaaaaagcgcttgactgaaatttaggtcatgtggtatattattaaatgtcgatacggaggaatacccaagtccggctgaagggatcggtcttgaaaaccgacaggggtgtcaaagcccgcgggggttcgaatccctcttcctccgccatattgattttaaacctaatgaaactcgagcatatattggagattgttttgtccgctgcatttgatgcagcggattttttatatgcaaaaaagcgattttctcttttggggaaaatcgctttattatttttatttctttctgttttcattgatcacgtgactgattttttcgatcaaaggttccagtgactgttcatcagcttcaagatcataatcttcaatgcgtactttcagcacagggcaggcgttaaaaccgctgatccagtcctcgtaccgcgtatacatctcttcccaataggcacggttggtctgcagctccatctcacggccccgcttttcaatccgctctataatgttttcaagatcgccttctaaatagatcaaaacatcaggatgcgggaagtatggcgtcatgaccatggcctcaaaaaggcttgtgtatgttttgtaatctgtcagcgacatggttcctttatcggcatgcatttttgcgaatatgcctgtatcttcataaatcgaacggtcctgcacgaatcctccgcctgattcaaacatgtttttctgctccttgaaccgctcggccagaaaataaatttgcaaatgaaagctccagcgttcaaagtcatgataaaacttctctaaataagggttttcatccacttcttcaagtgaggtattaaacccgaggcgttttgctaaagctttggttaaagtcgattttccgactcctaccgttcccgctactgttataatggcgttgtttggaatgtgaatatctttcatttaataagctcctttacctgacgggcaattctttcatagtctgtcttattcaaaacaaagtcttcagtatcaccatcaatagtcagtacagatatatccggatcttcttcctgaagctgtctgatggcggtatcgtaatctgcaatgagacgttccagatattgatgttcgatatttttctcaaacgggcgcccgcgtttttcgatgcgttgaagcaatgtcggcaggcttgcctttatgtatacaatgacattcggcttcggcaagtcgtgagtgagcagatgataaatctgcttatatttctcaagcttttgtccgtgcaatgtgcgttctgcgaaaataacatttttataaatatgataatcggacaaaacgggctgtccttgttttaaataatcccgatcagtgtcttcaagctgtttatacctgtgacagagaaaaaacatttcaagctgaaaactccactcctcgatattatcatagaacttatcgagatacgggttgtcttccacaatctcattaatcataggaaaaccgagctcttcagaaagcatagaagcgagtgtcgtttttcctgccccgataggaccttctaccgcgataaaaggggctctgttcattgaaaatcctccttaattctgcaaacatccgtcagctgccggcctttatattgtatcacactctcagaaacgcccatgaaaaaaagacgcttccaattaacgaaacgtctctttcacaatatggaattgatctccgagcaaaagccagttttgcgggaaggagaggccgagtttccaatagctgattcctcttaaatgaagttctttaattaaattaaatttcgcctgaatggagcgggcgtcttcaaaccatacttcatgctgtttctgattttcagccgtgtatcgaaagaagggagcctgggcggtttcgttatattgaatgtcgactttatagcgtgcggccagagcgatcgcctgctgaggactgacggctttcgctgtcgttccctgtttaaaaggcagtgtccaatcgtagccgtacatgttctgtcccatgacgattttggaagaaggcatttctgtcagcgcgtactcaatgacattccttacagggccgattggtgatacggcctgagccgggcctccgctgtacccccactcatatgtcatgatcacgacaaaatcgacgatttctccatgtgccctatagtcatgtgcttcataccatttgccggcctgggtcgcactcgttttcggagcaagcgccgttgaaatcttccagccttcccgatgaaaaatcgttctcgcttcacgtaaaaaacgattgtaggcttctctgtcctgaggacgcaaatattcgaaatcaaaatgaatatcgcggaagccgtgctttttggccgtggagacgatttcctgaaagagctttgttttcaccgtattatcatttaagatgagccgcccgagttcatcgctgaatgcgtcattttcaaggttggtgatgatcatcatcaatgtggtgttgtgcctgtcggcgatactttttaaattggtcaggggcggttcttttaaagtcccgttccgctgcacctgaaaactgaatgcgccgaggtatgttaaataaggtgaggcctctcttgctgcctgctgcagattagcgcttacgctcgttccccgcggttctatatatgcatttgattcgatatcgggcttattcgtctgctccggaatatacaggcgggtcccgacttgcactgtggagctgagctgaattccgttcaccctcgcaagctccgcggccgatatatgaaaacggccggcgattgccgcaagagtatcgccttgtctcacctcgtaatattgtccctcgatcggaatgacaagggtttgtccgacaaccaatgtattgggattaggcagtttatttgcttccgcaatgacatttgcggcaatccggtagcgcgccgcaatagcagaaagtgtgtcgccccgtttcactacataaatctgaatgaaaaacgcctcctttcatatccgctatcaaatgtatgaaaaaaggaggctgatcatgtttatttttcggaggtaatttgtttttcggtggttatttccgcgaagagtacattttccatcatggtcaaagcgaaatcattgtcttcgtcgttattggaagcggtgcagtctttcgggatggcaatgctgtattcccgcatataagcgtcgttagccgtgaacagcacgcaaatattaccggcaatccccgtgatcattaattgattcacttttaattcggtcagaagggtgtgaagcgccgtttcgtaaaatgcggaatgcttcggtttaatcagaaaataatcatccggctgaggtgaaatatcttctataatgtcggcgcttatgtcattgctgcattcctccctgatggcatcaatatcagccttccaaagcccgtaatgatcattaatataaataatcggccagttgttttgttttgcatgcttctttaatgataaaatacgggggacaatttgtttggttttttcagcaagacgttcgcccatatcaaattgaaaattattgatcatatcgacaatcagaagggctgtgttgttaggttcagtcaataccggcaactcctttctgctgaggtattcttattttaacctttatgagacatgaaaaaacttaagaagagagcttgaaccgatgaatgatgaatattatatgagagaagccataaaagaagcgaagaaagcagaagcgaaaggggaagtgccgatcggagccgtccttgttctgcacgatgagatcgtggcgcgggcgcataatctgcgggagacggaacagcgctcacttgcccacgcggaaatgctggcgatagacgaagcgtgccgcaagctgggaacatggagacttgaggacgccgttctttatgtcactttagagccgtgcccgatgtgtgcgggagccgtcgtgctttccagagtcgataaggtcgtgttcggcgcatttgatcccaagggaggctgtacaggaacgctgatgaaccttttgcaggaggaacggttcaaccaccaagcggaagtggtgagcggagtgctcgaagaagagtgcggagaaatgctcagcgcttttttcagaaagctgcgccggcaaaagaaagataagaggaaaaagttgtctgattagtacggttgcattttctgcctgaagcagatatacttatgtgtgcatcataaatggtgcgcatataaaaatttgatatttattttgccgtgctaagcggggaggtagcggtgccctgtacccgcaatccgctctagcggggccgaatcccttcacgaggttcgtttactgtaaggcctgccttaagtaagtggcgttgacgtctgggtcctgcgcaatgggaattcatgaaccatgtcaggtccggaaggaagcagcattaagtgaaacctctcatgtgccgcagggttgcctgggctgagctaactgcttaagtaacgcttagggtagcgaatcgacagaaggtgcacggtaaatcaatcatcaaatttcagactcacctgtttatggcaggtgagttttttcgtatatgaaaaacgggttttggcgttaaaagcccgttcatgtataataaacatgatgaataacagaggagggcgcatcctgtgggttaccaagctttatatcgagtatttaggcctcagcagtttgaagatgtggtcggacaggaacacattacgaaaacgctgcaaaatgcccttttgcaaaagaaattttctcatgcatatctgttttctggaccacgaggaacgggaaaaaccagtgcagctaaaatatttgcgaaagcagtcaactgtgagcacgcccctgtagaagaaccgtgcaatgaatgcgcggcgtgcaaggggatcacaaacggctctatatcagatgtgatcgaaatagatgcggcgtcgaataacggcgtagacgaaatccgcgacatccgtgacaaagtaaaattcgccccgtcggccgtcacttacaaggtatatattatagatgaggtgcatatgctctctatcggcgcattcaacgcgcttctgaaaacgctggaagaaccgccggcacattgcattttcatattagctacgactgagcctcataagattcctttaaccattatctccagatgtcagcgttttgacttcaaacggattacatcccaagcaattgtcggacgaatgaagataatcgtcgatgcagagcagctgaaggtggaagaaggcgcccttgatatcatagcgagtgctgcggacgggggaatgagggacgcgctgagcctgctcgatcaagccgtatcattcagcggcgatgagctggcggtggatgacgcattgctcattaccggggccgtttcccagcactatattggaaaactggcatccgctcttcaccgcaaacaggtttccgaggcgttggaaacactgaatgaattactccagcaggggaaagatgcggccaaactgattgaagatatgatcttttatttcagggatatgctcttgtaccaggctgctcccgatttagaaggagtcctggagaaggtgaaggtcgatgaaatgttccgggatctgagcggtgaaataccggcccccgctttatatgagatgattgatatcctgaataaaagccatcaggaaatgaagtggacgaaccacccaagaatcttttttgaagtggctgtcgtgaaaatatgccagacggcgcagcagtccggcgcagacatccctgaggtcggcatgctgatgaataagatccagcagcttgagcaggaagtggaaaggctgaaaacctccggtgtgaaagttcaggcggaaagcgctccgaaagaagccccgcgtcctcaaaaaggcggaaaaagccattacaaagctccggtcggacgaatccatgaaatattgaaggaagccacaagacctgaccttgaacagcttaaaagcagctggggcaagctgctggcacacctgaaacagcagaataaggtgtcccatgcggctcttttgaatgacagtgaaccggtggccgctgcccagaaggcatttgtgcttaaatttaaatacgaaatccattgtaaaatggttgccgaagacaataacggagtccgtacgaatcttgaacagattctcgaatcaatgctcgggaaaagaatggatttgattggcgttccggaagcacaatggggtaaaataagagaagaatttttaaatgatcatcagcaggaaagtgaaggatcaaacgaaccggctgaagaagatccgcttattgcagaggcgaaaaaacttgtcggagcggatttaatcgaaataaaagactaatgagatgaaagagagtgattgaatatgcgtggcggaatgggaaacatgcaaaaaatgatgaaacagatgcaaaaaatgcaaaaggatatggctaaggctcaggaggagcttgctgaaaaagtgcttgaaggcacagcgggcggcggaatggtgactgtaaaggttaacggtcaaaaagaagttgtagacgttgcgattaaagaagaagttgttgatccggaagacatcgaaatgcttcaggacctggttcttgctgcgacaaacgacgccctcaaaaaagtggatgacatgacgaatgagacaatgggacaatttacaaaaggaatgaacataccgggtttattctagggggataaataaacatgcagtatcctgaaccaatatcaaagctgattgacagctttatgaaattgccagggatcggaccgaaaacagcggttcgtctggctttttttgttctaggtatgaaagaagacacagtattggattttgctaaggcgcttgtcaatgcgaagcggaatctgacatattgctcgatttgcggacatattacagatcaggacccttgttatatatgcgaggatacaagaagagataagtctgttatttgtgtcgtgcaggaccctaaagatgttattgcaatggagaaaatgaaggaatataacggccagtatcatgtgcttcacggcgcgatttctccaatggacggcatcggcccggaggatattaagattccggaactgctgaagcgccttcaggatgaccaagtgacagaagttattctcgcaaccaaccctaatattgaaggggaagcaacagcgatgtatatatcgaggctgttaaagccctcaggcatcaagctctcccgtattgcccacggcctgcccgtcggcggcgatttggaatatgctgatgaggtcactctttcaaaagcgcttgaaggaagacgtgaattgtaagggaggaaatggcgaggcatgggttttcttcgcagaaatacattaagaaaagagtttgacgaaaagctgattgaacagctctttaaacaaaaggaagaatggaacagacagaagagtctggtcgataaaagtcttgagccctcggctgaggtgctgtttgagctgaaagtcgctgaatctaagtattttttttatttgaaagaagcgaagcagcggaatttaaaaatgagcaggtggaagtaagaggtctattctccgggatcttctcataagcttgtactaaacaagcgagggggaagattcatggagccttttttcattatcggtttaattgtcggtctggttgctttgctttttttatggggagtatctccaaagccagtaagatggattggtttgactgccattaagtttattgctggtgcgattcttctggtgggtgtgaatttgttcggcgggagtctcggcattcatattcctgttaatctggttacaaccggtgtcagcgggattttaggaatccccggcatcgctgctttaatcgtcattaaacgcttcatcatttaatttgtcgattattgttgacatgatggatgaagggtgatattctaatatacgtcgctgatgacgaaacagattctcgaaaaaagaatttaaaaaagttattgacgatgataacaacgatatgatataataattaagtcgcttcgagagaagtgttgtaagaattattgattgagtacgacataaacctagttatagtagaccttgatattcaaattcttcgtaccatctcccaaatcctcgaccgtatacgttacatgactaatgagcatctttagtattaagtttatttcagagttagacatcccgtcagtagactcaatcatctcctgcactttatgatgactccatttttctttttttgtctcagcgctaagagcattttgaaactcagtagatgcaattaattctgctaattcattttcagctttttgaagtgtctcttgtgaaattttcagcttttctttgtactctgttttactgatgtccccatctaagtacatttcctttatgcgttctattcttccctttgcctttttaacagctttttctcttaaaccaataagctgagctgtataagagtcatcattaacatcttgctcagtaggggagaagagagattcattgtatttttttatttccttcataattgactggaacagtacttcttcatgaattccttttgtttcttcgcattcttttgttctttcagcagattttcgtaaacactttctaacgtgttttcttctgcctttgggttgttctatagcttgtgctttatgacaataaggacatctaacaataccagaaagcctgtgggtattcatatttaaacgtcttccagccactttatatgttctaagtttttctattctattcaggattagggcatgttcttcatcggttttcatggtttcatgatgaccttttgcaattaatacttcatctagatttttattttgaacaatactgttgttgcttttgcttttcttgtatttaccaaaccatacataacccctatgaaaatcgttggacagaatttctgaaacaacttctccgtaccaaatggaacggccggatggggaagggactttcagttcgtttaacatctcagcaattactgtgcaagaatattcctcttctaagaaccatttaatcatcattctatatatttttttcttttcctcaacaactactgcagctttgagattcttgtcccacttataaccgtatggaacagaccctgaatgcagtctgccttctcttgtggcatttttctttccgttaatcgttctccgttttattgctctatattcacttcgagcaataattgattcaaactcagaaagcatttcgtcgccttcgattgataaatcataggttttttttggtgtaataaacaatgtcccactttgcttaaatgcttcaagtatacgtccggaatcaatttgtgatcctctagagagtctgtccattgctacagcacagactgcatcaaactcaccattttcgattcttggcaacaataatgaaaacattggtcgttcatcaatagtctcacctgagacaacttcctcaaaccactgaacatttttaaagttctctctttttatgagatattctagctcatttctatgtttggcgagtgtatcttctgaatctctgtcttctctggattttcttgaataaactgctattcttgaattttcgtgtaacgccaagtatttcatcctttcttcttattgtaagtgtagttagattatatcatgtgcattggaatttctttataaaatcctcattttaacgaaatattttagatcaacttgcttattaatctaatttaaagtatcctaattgatgtatcatagggggtttaatcagccactatagaccacagagtccctcacacgctctgtggttttttgtttagattggaatatacccaaatgaaaaaagaagcctcagagggcttcaaattgattaattcttctcacatgcaaagttgtcattatcccgatccatcttagatgtataagcagggtgagtgcttggtactccatgcggatatttctttctcagctctgtgcagtttgcaaagtgttctgttcctccagtagaaggggaggcttgtgtagagttagaagagctacttgatgctgaactacttgaatgggaactgcttgagttcgatttatgtgtctcagattgatgtgttgtaactgacttttgagccggcttagatacacttactgatttcttcggtttagttacgcagccattaaatcctttatcagttgcatagtcattcttactccaaatcttcaagtctttatctttcgcagcttgctcatctttcttatacgtgtctaaatacttcgtgtttggctcatatacataagctactcgtgctaatccttctttaagcagtgtttcttgtactgatttgccatctgcgtaaacgtaagccagcattctgccatacttgtctgtacgatctcctttatcaaactccagttgaagttttcccttgttaaccagctgtttgtttcttgctgaagcatcctcaccatatggttgcacacaagagtatggtttcttagtttcaggcgtgtcaacaagcaaataacgaacagttttgacctcgcctttatagttaactttaatcgtgtccccatcaaccgttctgtttaatgttacatcgaccagctttttcttattgtcagatgcctttttatccgacgaactcttctttgaagcatcttcggctttttcattcttgccatcacttttgttgtttgattgattctctttcttttgtgttgtctctttttcactcttttcttcttgctgcgttgttttagctttatctgaatctgatttatctgtagaagcagagtcagatccacacgcagccaaagaaaaacttagagataatgcaccaatgcctaataaccatttcttcaatgtaattcccccaaattgtttgttctgtctttatatcggacaaaccttcctaattataattatagaaccaaagattgtaaatttaattttagataaacatctgattttgaaaatcgaagaacctaaaactatggtaaaatttagataagattaagtgggaaggagacaggtatgcaagtatttgaagcatcctcgttaatctcagcagcggaaaagcgggcaaaagaatacgatcagattagagaacaatttatcaatctcagaaaagcatttcaaggaatggctgatttagatgacagcgagttttcaggtaaaggtgctgataacattaaagcattcttccaagatcacgctggtgttacagacagctggcttgatctgatcgatatgaagattgcttttcttaacagtatttcaggaaaagtagctgatgccggattagccgattcgtttgtggaagagtcatttttagagcatgagttgattcatgcgaagaataagtcaaaagccatcatgcaagagcaacggaatgaaatgagggatattcttaatgagataagtgatattgttcatcttgatgttttctctacagaggatgtcgatcaaaagctggattcagcagataagaaacgggacaataccatacacaagctcggaaagctcgatcatgatctaacgaaggaatatgcagaaaccgaagcgaacgagcatttcatccaagccgactttcaacagcttcaaaatgccacgggtaaagggaaaaacgcaacaccacttcactataacgccaaggcgtacagagaaagtgacatacataagaaaaaaggcgagattgcaagacattcggatgcttatttgacgattaaaaaggaagaagcgaaagagcgggaaatcaaggatctgaagaaaaagctcgctgacggtgtgaccgatccggatgaatatttagaaatcgcgaagaagatcggctatgaaaaccttgaaccttcccaacaacaatatgtgatgcaacttgaacaagcaaaacagatggaagaagccggagaagtgacttgggatattttaaaaggagccggcgttggtttatatgatgtcgggaaagacacggtaacaggtttatggcagctgatcagcaagcctgatgaagttgttgaaggtatcataggggcagttgctcatccgattaacacgtataattccatttcaacagctattgaggaatcgtatcaaaaagatatggtaaatggagatgcttactccagatcaagatgggtgacatatgcgataggtacggtagttacctctgtagtaggcacaaagggagccggttctcttacaaaagctgacgtagcaggaaaagtcacctctaaagtcagtaaagcaggccaaaagctgaaagatgtctcaattgctgatttattgccttataatccacgttacgatgttgttccggctggaggagttccttataatgtagttaacggtgagaatttaaaggatcgtctgcttcagttaataaagtctgccaatcctagaacaaggttgcctagaaatcatgggagatgggaagggactcctggtaacggtaaatggcactcagatagacctgacgttaatgcagttactaaaggagaacccgtcacttttatagatggcagaccgatttttacaccatggagcaaagggacgattaagtttaaatcaggagaactgaaaggtactaaaaaggattttccagcagtttataaacgtattcaaaaaatgaaaggctttaaaacccaaaaagaagctgaaaaatggctgaaagaagtagttagattaacaccgcatcatttagacaataacaccatccaattaatccctatggatttacatggtaatatacctcacgtaggttcggcatctgatttaagaggaggattttaatgagcatacaggcaatcaagaaaaaaatgagtgaattttatttagatataagaattgataagaacataaactctcatcaagtccttaaaaaatttgaggacgaaaattctttcgacataacagatgattataaagagtttctcaatttatatggggaatgctggatagaggaagataatgtgtttttccctgttttagaggacaatccactagcagataacggtaatctccggttaggatatttctacggtcttaataacaatgatgctaatattatcaaattaaaagagaatctttcagaacaaatgccggactggattataccgattgctgatggtgacggaggagatcaaatttgtcttggtgtgaaaggagaagcagcaggaaaagtttatttttgggatcatgaattgacaaatggagtaaaagacacatttttggtcgcaaactctttctctgacttcattcaaagtctgtttatagaagaggcaacagatggggacgatgaagacgatggtattttatctattgagctagatgatgatttattaaacagttaagcaaaagtattgcaattgtatgagatgatgcaaaagtaagcattcgtaatcaaaataaaataatggttttttccataaacaaagtattgcaaattatttcaatggtttcacttaatgtgttataatcagaactgtaagatatttgatcggttacagtgtatttctttcataagaaatgcataaaataaaaagaccagggtgttggtagcaccccggctctgtacgaaaagctgcccatcaaagggcttgctcgatgttgaatctgcgtagacctaaccctttaaggttcctaagctcaagggaaggtctattttttcttttggcttgacgttacaatcatcattatattgaagatcaacaagacggtatttaatatcaatccgccaaaattgatcattatcattaatgattcgtaaacagtcattttcccaccccctttctataggggatgagcaagactcccttgagtgagcatgcttcaatgtacaggaatcattatacactaattccaaatatatgtctgtgattatagcaattatattgccaaggtgaatcagtcacttgagcatcaaagtttaatgattaggacaatatcatgtaatctttattgtgtaagtgcatctgggatattataattttaaattgttgaaattaactaagggagaatctgacgttggaatttactttagctaaacaggttttaaagttttcattaacaagtggcaaaagggcagaaataaatgtgccaccagtgctcaataaacaagacattaagatattaaaaagtcaattaattgttatggagatgcaaacaaaaatatctaatgaagatatgaaaagaaaaaggattagaaaaacgaaaataagcaggctataaaaatagcccgtcatttgcgtgatccgaaagaaaagcaatactttgtgccggagtttttaagtgtgaaaataaattactatgtccccccttacaagcatacattgtgatatgtaagggggggatttttcttgcctagataccggagcgctcttcgcaagagagggcctttgccttttcggtatgtgcttcttctgtcgtttgcttttttcaccatatcgacggtcattagcctttggatgatcaactcctcaatcaaaccggtgctgatgaacataggagaaatggaaaccaaacgggtggcgacagaggtcattacggaatccattgaagaatacatgtctcacagtgacaatgtgaaagatatggtcgatatgaaaacggatgaaaacggaaaagtcacaacgatggattttaatacacaaatggtcaacagtatgaaggcgaaagtgacaaagcagctccaggctcatctgaaggaagtggagtcgaacaataagcagcatgaaacagaaaaaggcgcgaaaacggccgatgcaattatgattgatattcctttagggcaggtcacgggaaacagcattctcggaaatctggggccgaaaatccccgtgcgctttaacctgatcggtgatgcgttaactgatgtgaaaacaaaaataaagccgtacggcattaacaatgccctgatcgatatcagtatttttgtggaaattaaagtgaaggtcattattccgtttgccagtaagacatcagtcgtcacaaataatattccggtctccattaaagcgattcaaggagaggtgccgcagttttataacggaagcggcggatcaggtgtgacgccttccgtccagttgccgaatgaaaaaaaggagaaagacaaataaagacacacagccgcattttcttctggcggctgtttttactttttcctgtggatttcttgaaactgaactcaaagtatcgactagagaagctcataaagcttagtggatacttgctgaataatcatttccaacaattacatcgaacgattgttcctgtttatattgaataaagaacgtttgttctgttaatattagatcaataaaggagtgattcaaaatgcttagagatcgaggagcgatcaaatggacttccatgatgcttccagaacatttaacgcaattaaaacaggacttgttagatgtttcgaaaatggagaagccatctttagatgaacagcaaattgaggagattgacatcttggtttctgaagcaatggcattcaataaagaactgaagtttaaactctttaaagaaggaattgccgaggatttaatcggtacagttcaatatctcaattacgaacaacacaaattacatgtaaaagatcatcacgatcaaaccgtatacatcaccatgaatgacatcataggagttgcttacaatgattgattactcacagtttccacgtaaaaatatactttgtgtagatatgaaatccttttatgcttcagtatcgatgtattcatctgaaaaagattataccattctcgaagacaaaaccgcaacaggtaaaaagcgggattggaaagggaaaaagagacggacgaatcttatggcagagcattatgaggcgttgcagaagaaaatcggagcaccttactatggcaagaaagctgaaaagctaagtggttgtgcagagtgtctttcgtttaaaagagatccggagacggacaaactaaagctgtatcaagcccatttttgcaaagtgaggttatgccctatgtgtgcgtggcgccggtcgttaaaaattgcttatcataataaattgattgtagaggaagccaaccggcagtacggttgcggatggatttttctcacgctgaccgtcagaaatgtagcaggagaagagctgaagcctaagatttctgacatgatgaaagggtttaatcggctcatgaaatacaaaagggtcgatacagctgtacttggctattttagagctttagagattacgaaaaatcatgaagaagatacatatcatccgcattttcatgtgttattgcctgtgaagagaagttatttcggcaaaaattatatcaagcaggcggaatggacaagcctttggaaaagggcgatgaaactggactacacgccgattgttgatatacgaagagtcaagggaagagctaaaattgatgctgagcagatcgagagcgatgtgcgggaagccatgatggagcaaaaagcagttttggagatttctaagtatccagtgaaagataccgatgttgtgcgcggcggcaaggtgacggaagacaatctgaacacggtgttttatttagatgatgcgctttctgcccgccggcttattggctatggcggcattttgaaggaaattcataaggagctgaaccttggtgatgcggaggacggcgatcttgtcaagatcgaggaagaggatgacgaggtggcgaatgaagcatttgaggtaatggcttactggcatccaggcattaaaaattacataatcaaataaaaagcagaccgattgatggtctgcttttttgtattactagctcgggaacgtttggtagaaagcaacaatgccgatcacgcttagcacaactaggattcctagaatgctccacaatgttacttttacacgtttagacataccatgacctcactttttaggctcaatcaacggtgaattttttgtaagtgcgttttccatttttatcgccgacggctttgataaatacgttacctagagtgataccgatgtctttgattggcccgatttgataatagaaacttcctgaaactgctgctttgttatcgcctgtaacccaagcgttcttgccgcctgtgtttaagcctgttcttactactggattcaagttgcggactactcttgcatttgaagagttgatctttttcacttttccaccagatacattgtagttaacggaaactttgtaagtagtctgttttactccgaaaaacttaactgagttctcgtaagaaacgcctttgtcccccatagcattgattgggtcatcaacaacaatttcgttttcttctatgttgataggatcgatctttgtaaagctttccacaaacttttcctgatcttcttttgataaggctttaaaatcttcaaggatttttccagcttccataacagctgacgatatgtactctggagatacaccggctgcttcagcggcatctgaattgtaatttgcgaggtacttttcataatcctggggcgtatattgacttttcacttcttgagcagatgctgcgcctgaaggcaataccaatccaagtgtaacaaaactgataatcataaacagaaccaatcttctcattttgacactctccttcataagatttttgaaccaaaattaaggtaacatagattgtctgttcgtgaacataatttaacatatttgaaaaataattgattccaaatccccacttgtaatattttccgttgcgggactttttcggtcatggactattcataataagatgaaaatttgacacagagaacaaaatgttcatgtgttaaatgctgcgggagcagaaagggttttccgatttcctgccgatctctcatcggcggaaaaatcgggtcggcatgttgccgacaagtggcacgaactttcgatgcgatagcgagaatgagagagccaccggcaccgcaggtcgcacgtccaaattgaatccgtaggaacaatttggtgtagtgcgttacaccaaaactgaaattttgtgttaccataaccctaatagagtggtatgtattggggggttcgtgtggcaaattatgcggttatcaggatggaaaaatacaagaaagatagactgaatgggacgcaaaaacacaatcagcgggagtttcaaaaaagcaaaaatgaaaacattgatcgtggccggtcgcatctcaattatgatcttgttaacggtcaaccgatcagctacgcacaggcggttcgtgaaaaaattgagggcagggtcaaacggaaagtgcgggacgatgccgttttagtgagcgagtttttgattacggccagtcctgactacatgaacggattgagcgagacggagcagcggcgctattttgaagcggcagtggatcatctgaaagagaaatacactgcggaaaatatgttgtatgccacggtacatatggatgaagcgaccccgcacatgcatgtcgggattgtgccgatcaccgaggacggccggctttctgctaaagatttctttaacggcaagctgaagatgaaagctattcaggatgattttcaccggcatatggtgaagagtggttttgacttggagcggggagaaccaagcgaaaagaagcatgaaaatgttcaccagtacaaaatcaatcagcggaaagcggagcttgagcggctgaacgctgagatcgctttgaaggaaaaacggaaagcggaattggaacagcagaaccgagcggtcgaatcagtggtttccgtcaaaaaagaagcgctgacggccaaaacgcaagagcagaggatcccgaccgttgagtatgaaaaagccggtcttttcaaaaaagacaaggtgattatgccgcagcatgaacttgaaaatttgtatgcttatgcggaagatcaagggaaaatggcggcgcaactgtcgcggcaacttgaagcggaaacggaagagaaggaacggtggaagtccatagctggcgaagaaagggagcgggcagattcgaaagataagatgctctcggatctgcagacaactatgaacgaggaggtcgaaaaagcaaaaaggggtatgcggcggaagctgactaaagaatttacggaagagcagcgggaagaactccgtcaggaagtgaaagaagagctgtctgctctgaaaacagaaaacagcgagctaagagcggagaatatggatttgaagcggcttacgctgtctctgagcgaacaaaaagacaatgaggtcaaaaagcacgccgaaacgaaaaaaagccttaaagcggaaagaggcaggtatggtgagctgctgaacttcgcccaagagcagaataaggagtttcagtcgctgaacgaggaaaataagacgctaagagagcgggtggccgtactggaacagtggaaagacaaaatggtgcagtgggctaaagagaagttgccaagggtgcggagattagcggtttcatttttcaatgcagcaggtatgcgtcgagaagcagctaaatataaggacaatgaattggagcgataaatggttttcattaactgcacccattaactttacaccatcaaaagcttgaacttattgatataaccaagttttaaaggggccaattttgatttgttttacagtttgttttacaaatgttttatcagaagaagaaataaagaaatataaaagaataagagagcgtggtgtgcatatcagttatcctttccaaaattgccaccactttttttgtttagtggctgcgatcattctttgtgtctccagagactcccgtaatgcggcggtgagtgtctcatgtctttcttgctgtcttttttcgaattgttccatccgttctgccatctggcggttaaattcttcctgtcgcttcatgaattcaaccaaaggattgtcctgtagcgatgtagcggtatccgatatggttagttttgaacgatataggcttgctatgtgctttaccgtttcgtcgagtgagtgtccattgatcttagtcattgtacatagatactctaaagtctttacgtcatcctcggtatagagtcgccatcctttcgaatctttattgaacgagtagccttgttcttcaagcatactggcatacttgcggacagtcaccggctctataccgaggtgttttgcgacgtccttggacgataatttgactcccatatccatcacgaatcacctcgtaaaataggttcgctatggcgaggccagacaccttcaagtgttgcaccctttattatgtttgagttgttttgaaaagggtgcatttcaaaaggagcgctgcatacctaaactagaggaaaaacccagtcatgacaggggactgactgggttcttttgtgtttgagtttgttttggaatttaggagcgttcacggagtgcccagttatacgcaccaaataaattgggcgtactggcggaaatgacccgcaggggcttttgataaagaggaggggggtagtaatgcaaaagattgattttgaaacagggatgaaatatgtaagagcaaccctgggctttgagggtttagtgctgacggcagaagaggaaaagcttttagaaaggcggtttcatggagaaatcacagaagaagaatacataagaaaagcgctggagctgtcttatctctaaatgggcagcgggcgctcttggcgtgagtcaacggtaaccggaccgtagggaggattaaggagttgactcactcagcgccacccgaaccctttcagcactcaaacaaacccgtttgtttgacgccaaccggcgagggagccccccgaagattcggggggttggggggattgagtattggcatccaacggccatccgttggtgggtttgggcaaagcccaagaacttgactagtgaattgggactaagttactcttgaaggagaaaaaagatcgggaaaaatagttggtgagagaagggagcgtaaggcgacggcagtcgccgagcggcagcgatagcgaccggatcgaatccaaccgaatacccctcctatgctaacaggggggtagtaatcgtaagtgttaagcggaatccaaatgtgattccgtttttttatttcaagtatttgttgtgtagtaatgagattcctactccggaaatttatcgttgcggcatgtcgaaaattttccgcaacaaagttatcaatccttctcttatgctaccattttcataaaaagggttaaactggagggggacgagttttatgagtgccattccgtctgctactgtgggggttaaaattaatgattggcatgagtatataaacagatttgatgcaaaaaacgctgaaaaatgcaaagcagaagtagaaaaaatgatcgaggaaatggaagaggaccaagatttattactgtattatcagctgatcagttttagacatgatttgatgatggactatcttttcccgtcagattcttctaaaaagttggaaacttgggagtatttaagaaaatctgaaggggccggacagaagttaacgaagctgctgaaatactatgaccatttgtttagaggaatgtacgaatttagaaacggggattatgtagcggccattaatcattatcaaaaggcagaagctaagattgccagagtcactgatgacatagaaaaagcggaattttattttaagatggccgaggttttttatcacatgaaacagactcatgtttctatgtattatgtgaaaatgtcttatgataagtataagaagcatcctacatacaaagtaaatatgatcaaatgtctttttgttattgcaggaaactatgatgatttgaataaccataaaaaagccttggttcatttacaaatagctttagaaatggctgaagaagttggcaatgaattgatgcagacatttgcatatttaaatatgggcaatagctataaccgtttgcaaagtccaatggctattcctttgtatcaccaagccattaagcttgcaaaaaaggcgggggctaaagaaatcattcaggcttattacgatttgtcccttattcactttcagaacggtgaaatgatcgaggggatggacttttttaaaaaggcagtaaaggaagctgaagcgttcgaaaatgaattttacatgaaattgttgaatgtactaaaagcattatttattgatactgctaacagacaaaatgtaaaaaatgcattgtacggactaaagaccgaaaaaggctatccatactttgaagagctagctttagtggctgcagaattctatactaagaagaggcgcatggaagattctatatacttttacaatgaaatggtgtgcgctcaaagacaaattcagaggagtgattctcattatgaaatttaaaagtctttttgctgctgtcctcattttgggtctgttagccggcggtgcaggttattctgtttctcatggggaaatttcagttgcttctcgaaatgcaacataaggaaaatttaaggcctaaatggggcggactcttagagtctgctttttttattgcaaaaatcgttttaaagctttttaaggcgttttattgggttccctttataaaagggggcgttttttatttaaagcccgtagaaacgaatctgagcattctgaggacgcctttaggtatgcagattagctgttcaccttttttaagtagcgagtagcggagtgcccacttacgcaccttatcgaaaggtgctcgttttttcgcaccggcgaaataaataatgctacgcatttgaccatggctggatgtgttgacagggtgttgatagaaaaggccatgcgctgactgtgtggaggttcatgtgttggtcatgtggagacgtgcggttttttaaagatattgaatatctaaaataatgcgcggctgcagggccgattttttgaaaaaaaatctccccctatggggaagaatggttttgatcttaggttttgggttttaaaaaaagaccggcaattctgccggccttttttacgattttgacggagtcgaaatcgggtcttttcttatcttgatactatatagaaacaacaagattttaaaaaatcacgttcagcccttgtctgtcaagggcttgagctaattttgacagataaaaactccatctgctattatttaagtaccaccaaaaataatagaatgctagaggactagcaacagaaggagttttttgtattctcccgatacggcgccagcaggaaaacgtctgaaggtgaaaacgccccgcgtttacggggcgatcgggaaagcaccggcagcgccgtgccatgaaatctctgcggctcatcgaagctgcggggcagccggattccggagccgaccaggcgccggcttttttgtggttagggcaggcaacgggccgccctggctgcagctgaaggagctccacggccgtcggctccgatgcggcgccagcaggagaacgtctgaaggagaaaacgccccacgtttacggggcgatcagggctgtaccggcagcgccgcgtcatgaaatctctgcggctcatcgaggctgcggaggcgacaaggttccggctttttttgtgtcctggtcaagcaacgggccggccaggcgccggcctttttgtagcctgcaccaagcaacgggtcaccctggatgctgaaagagatccgccgcgtcggcaacagcaatacagcaattgcaggaagaacagctgtgttgaaggcgaaaacgtctcgtgtttatggatgctctggtagcctgaaaaaggtctacggcagatgatatttcactctgctgtcggctggaaaaatatcttgtgttaagttgataagcaacagcgctcttgtgggagtgtgtaaggtctaatggattatgtattcattatctgatcctttcactttgactaataaagattcattcgatttgaaggtttagataaatcgtcttggtaataaagtcatttttcgacaaaaaacgtcaattttcaagtgtgtttgtcagaataaaatggtaattcgggatgatgacccattgaatttttacatttagtataaaaagggtataaagtaataattgataaggaggtctatgtaaccaagatagtgaaaaaagatgagagtcaataatttcagtgaaaagaagagatttataaagataaagagtattctactaattgactcaaaaaatatgcgcaccaatcaaattgttgctactaaccttatcaaataaataaaagttactgatcattcatcagtaactttttattttgacttgtcataggaggaatagacaaatgaagaaaaaaataggcgttgcttctgccctttctgctgtgcttttattaggcgcatgcggaggacaaaatgattcttcttcttcggagcaaccaaataagaagaatgcatctgtaacaacaaaggataatgaggaaagccaggcctcttttaatcttcaaaaaaacgatggccgcgatgtatctaatgtattcaatccttttattaaagaagctgtagagggagatgtagaaacagtatataagaatgctgatcctaaaatcaaaatcaattttgatgggtttaattttagtgtttctcaatatcaagtcgttcatatcaaaaacgctaagaatgcaccatacagctttaaaggagggaaagaaggatatgttattacgctacaagctactataaaaaatcaaacagatggaaaggcatacttcaataatcctgttctccagggaagagatgaatatcatacaacgcaaccagatataaatttggttaaagatagtgacaaaatcaagcctagtaagagtggaacccctggatcgccagcttattatgaaaaaggtgaagcgaagactggttttattcaatatgaattatcggcttcagaatacaaagagtttaaaaatgaaaagacaaaactagtgatttcccctccttcaaaagattctatgttccgcgagcatatcggtgaaaagcaaacaagggatctcccgctgtctaggaattctttggaaatacaaaagagcgataaaaaattttatgaggatcagattattcgcaaaggtattgccgaaaaaaccatgatagaactcaaagacggtttggctgacaagaaaagtgaaaataaagttgaattgacactggaaggctttcaatttactaagttagctccttcagttagtttcaaaaaatcttttactggttttgggaatgaggatattgttgcagctacctttaagttacatataaaaaacaatcaaggtgacaccctgccattaggacagttcagctcttttttagacactgacaagcgacattatttaaatcaaggatcattagagtatgattcaggagacctccggccaggacagtcaggcacaaaatatttagtgttcttgatgaaaaagtcagaacttaacgaaaacccaaaattcaaattgcgcattagacatattgaaggaaatagtggtgacgcgttaaatgatcgagaggttgactttaatctggttcgttaatcgaaactgaagagctctctattaactacaaaatcatgattgttctcattagacaaacatgataaagtagaaaagtagaaaagtagagaaatttaaaagttgttgtttctaagggatcaactgatcctttaaggaggtgattaaatcgattctgaaatacggacaacttaatacttcggtttcttttattgatacgagttagaattttccctcttttcaaaaaccacttatcttaaaaagaggagaaatgtatatgtcaataaagaaactatcggtgctgtttagtatttttttgattgctttgagctcgatcttctcgtttgcagggaacaaagcttttgcagattcatttgcgggagaccctaatactaaagttactggatgggcgtttgatgagagtatcggcggatacctgcctaccgagcaaatcaagtcagtaagtgatccgaccagatttgcctattgcctggagcctggaaaacactctcctgaccatgtagatatgccatctgcaggacaaatgaatgacaaggtatatcgggttctgtcatatggatatccaaacgctacagcgagcgaattaggagttagtagcaatgccaaggctcattatgccacgcaaattgcaatttggcttacaatcggtgaggtgaaagcttccaatcttacctacagtgacaatagcatcgaaaaggcggttcagcaccttttaaataaagctgcaagcgaaaaagatacacagaatgtcagtgttacagtaactccggacaatgcgaaagcatctgtgaaaggagactatctcgtaactgagccgtatacagtaaaaagctctgcaacaggtacatacactgtttctttgtctggtgctccaaagaatgcagttgtaacagatgtaaatgggaaagtaaaatcaacattttcagcaaacgagcagtttaaaatccagttgccaaaaaatactccgacagacaaagtcaaagttactgttaatactgaaatgaacaagcttgtatcaatgcaatacaattcagatgggacctatcaaaacattgtgtctttaaaagaggttaaaaagaatgttgaggtcggtgtctctgcttcatgggaaacaactggcgcccttcaaatattaaaagtgacagaggacaatgcaccgttaacgggagttatctttgacatttttgatcaaagtggtgagaaagtaacttcagttcaaacagataaaaacggtaaagctactgcttccaaattgccgattggtaaatatacagcggtggaaacgaaaactgctgagggtttcattttagatcaagagcccaaaacagttaccgtaaatgcagatgaaacaactacactttccatcataaacaaaaaaattcgtggaaatgttgaattgaaaaaaattgatactgatagcaagaattcattagaaggtgctgttttcgagctcttcaataataaaggaaaagcaattggccaatacacaactgataaagaaggaaaaatcctgattaagaatttagaatatggatcatattcatttgttgaaaagagcgcacctaatggctatgttttaaacactgagccaattaattttgaagtcaaagaaaataaaaaaactgtgcaaattcaagcagataacaaaatgattaccggctcgctagaaattacgaaaaccgatgtggcagacggtaatactcgcttaaaaggtgcagaatttactatctttaatgaaaatggtgaagaggttgccaaggggaaaacagataaagatggtatagctcgttttgataatttaccatttggccaatacacttataaagagacatttgcgccaaaaggatatttaatcaatgaggaaacattttcttttgagatcaaagaaaatggccaaatcattaaacacatggtggctgataagaaaaaagctgttgccgcagctccagttttcgaaaaagcttcacctgtcgtgaaaacagaaaaagtgcaaactgttgttaaaccggttcagaatactgtcaaagaagaacagccggttaaagaaaacacattgccgaacactggaaatcctaatcagtaccgagctgtaatgattggccttttcttaatcattatcggtgccgcatggtatttgttaaagcgtaaaaagacacaatctgatagtgagtaagatgacatagagagacagctgtttgctgtctctttcttatacggaggttttttaagacatgaagtctaaactttttcctgtttttttgataattgttggactgttggtagcttggtttgggggcggaaaagacataatatcgagcaagcagaaaacaaacacatctcttgctgaagcgaaagaaatcataaaagaaagcaagacagagaaagcttctgaaaacaataagcaagaaggaaaaaacgaatcattccaagtgaaaaatggtgaaacggttgggattctctctattcccaaaattgatgctgaactaccgattgtggaaggtactgcagcagaagacctgagtaaaggcgttggtcattataaaggcagcagctatccgaatgagaatgggcaaattgttctttcgggccatcgggatacagtttttcggcgcactggtgagctaaagcatggcgatactcttaaactaagtttgtcttacggagaatttgaatataagattacagatactaaaattgttgatgagaatgacacttctgttattactctgcagcataaagaagaagaattgatactgacgacatgttatccattttcatacataggagacgcaccagagcgttatatcatatatgctgctcctatttaattagacgcttatgattagacgcttatgaaatgtttatttgtattgacagacaggtagtggaaagataagatttacacaatgataagtcaatctccacaaggaaggtaagttttatgtctgcaaataatgaagtgatagtgactgcaaagatttcgaaaaaaacggacgatatgctggatgagttaaaattggaatcgaaaaaaaatggtgaaaaaaaatacaaaaaagaacttatggagactgcagttactgaatattacaataaaatttttaaaaaatagatactgtattagaaggaagctgtcatcaagatagcttcttttttaccttcaacagccagggcggcccgtagcctaccctggccggttccggaatccggctgtcccgcagcttcgatgagtgcggaatttcacggcgcggcctgtgctttcccgatcgccccgtaaacgcggggcgttttctccttcagatactctccggccggcgccgcatcgaaaccgacggccgcggatctccttcagcagccaggacggcccgttgcctgccctggccacaaaaaagccggcgcctggccggttccggaatccggctacccccacagcttcaatgagccgcggagagtccaccgcagaggcgctatttgtccctaacgaaggaaatatgctcccaatcttatctgcataccatatcgatctacagggcgacttcttaatctgtacgtactttttcgtttcagccattacgcaatctctcctcgtttttgttttcgttagaaccacgcatcatccacgccttcattgcgatcagcccgtttcagttcggcttggacttccgtaagcacacgcgataagacactttcgcgcatatatgaaaacatgaacgcaaagttacagcccggatacttcagcgtcggctttttctccgcgaaacatttatcgatgaatctccgcgtaacctcggcgccttgctcgtcgatcatccgctttaggtttttcgcctccatgccgcggttgttcgttacgtatggaattccgtaagtttctttgtgcttggcgtgcaggtagccgataaaatcgcgcgtattccacttggcgaccggcttatctactttttcggacatagacatcgctcccttgctccgcgcatctcgcaataatccgtagtcgcgcttcggctttttctaaatgtgttcgcagcacatccgcctcttgttcgagcgcttcaatgtgaccaagcaaacacgcaatatcacgaggagactcttcgataaactccgcatcgtgttcgctgatctcgatgtactttccgccctccgcgacatctatggcaactccttccgctcctgaaaggcacgtcgcataatacccttccaactcccatgtccattccgcgtcagtaattcgttcgactctttttcgaatttcatcaagacctgtcttcgttagtttaccgctcatcttccggcctcctcatgtaatgcttcgatttcgtaaataagccgccaaacgtgatgataaaggtgttcaggtacgccgagcttcagcgccgctattgattcgtttaattcgtatggtgtcggtcgcttcatacgtcgtcaccttcccaatgaccatacttcctcattatgctaattacctcttccgcataaggctcatcttgattaatcactaggtattgagggaaggattgtttatcgtctaccactcgatttaaagcgatttctacaccgagatcatagagggcttgttgctgttcatcggttccataccgagtaacatcctcgtttttaagaatcgtatatttactcatcgtgcgttcactccttcgattttgattccgagaagattgagcgtattgataacgccatccctttcgcattcaagactgaacgtaacgccccgggattgcgcagtccgttgcttttcctgaagttcgtcgtaatactcgcgtacccggtcttccggtgtaccttcgatctcgtatccgttaattaacgcagccgctaatgtggtgacgtccatatcgtcgaaagtgtgtccgtcataccagcgaggagcgtgcctcgataggaagtccgcatgtgcacgtaatatccaatcgtcttcgtgtccgaaccctcttgccgattcgattgcctccgcctgttccttcgtgattgtcggcttcattttagcgcctcctttgcgtgtaaattaatttcatatagcgcagtaaccggaaccaaatcgacgctttcttcgggtaactgcgactttatttcgatcaccctcaacgccgccgtcaaccgctcattctcgccaatcaaatccgccacagcacaacgcaatcgtttaacttcttcggtcatgttttcgccgcctctccgccgttttatcgtctaccctaccgaataccctcgaccgtcagtaacgccgctaattcgccgcgatacgcacgtttattcgtgctaattccgccagcgattgcgcatccgaagacctcaaccgccgattcattacgtccgtcagcgcgcgttggtaatcgggtgataccggaatgttaatcgtcatgctacaaccgccgtttcctcgtcgttaaaagcaccggccatttcgattaaatatagaagccggtctgctgcgttcgacgtataattcgtaccaatccacgcagaaagagagttcgggtcatttcgtttagataacgcccggtgaacaattgcgtggcaatttgggcacaacggtgcaatatttttaggatcattactacctccgagtgaaatcggacgaatatggtgccaatcgacaattggtgtactgtctacgccacaactatcgcatctaatacaatctccgtaagaagtctcaagcctttttacaacctgtctggttgactttctggttctatccgcgtcttctaacgatttttttagtgatctgaaagacttaagtgttcgcaccctcccctgcaaaactgcttcctttgctctttgtttgtatagattagattcagatgagggtttggatatctcatataacaaagacacaggcaactcttcaaggtactctgctatatttgaatgacggctaataagctcatacctatgaattagtctataagcatgacctctgctaattcctagacaggaggaaacccatactccgaataatccataaccatgtttagaaagcttttcttgcgcctcgtgcaattcttttccgatacgtgtgtatgcatcagaaacgattccttttatctgcttttctttttggaggataaattcccgtgtgtgtttatccaactcgttataaatatccataagacactccccctgtataagagtcattttgtgaacgctttttaccgcgataagattctattaataataaatatctgcgcgaaaggtttttaattgagcgctattatttattctttttaaagatattctttttaaagatattctttttcagttacaggatagaaagtttatatatacagagctgtaaggttatatctacgcttctgtaagtttagctcgaaactctttaccgaaaagggattcggctccttcgatttcttctgcgatctttttcaacgcttcagcaattttcggctcagcccaccggaatttctcccgatctaatgggtcattgacgatgtaaacgattttgtcacgccctcgtccgctcggctttgtctcaatttcgactagcccggcttcctttagtattgcgtcgagtatcttaagcgtcgaatacgaaaggttaaacttttcagcaacacctttccggccgcgccacgactttccatactcggaatcctcgcgattgtgtctatagcgtagcagaaacgtatagtacagcgttgccttatcgcctatataaccgtggtacagatcgaatagttcgtggtaaaccatcgaaaagttttcgcgtgtgttgccgcttcgtatgaatacgtttgtcatgccgcatcgactcctctcttcatttttatttcctcggattttagttccaccaaaaacgagtttaaccgagaaaccagttcgttgtttccgtttttcaaaagcgacgggatgaactcgctgatgtgtgtaagagtaacgttaggatgtgcgaaactaccttcggactctttggcgtaaatgatcgtaagatgatccgtatggcgcaaatacttgtcgaacgttttactagcgcgattaaatgcggtattctcgcttaacttagcatcgatccatttagttccgtcaacaatgaaatccgggatgcagtcataaattcgcttttgttcctcgaccgatccgggatgtagcgccttgagaacttcaccaacaagcaactcaaattcgcgtcccttcgttatatagaaagatgcgtaagattcgttgataagttcgtatgacaatccccattcttcgcataatttcctaacactatggtcgtaatatttccgtaagtaattttcgatgtgccacagtttatttccgtaaatatactcgcgtctcaaaccatgcggaaacgtagctctaacgtaggcatccagcgcctctttttcgagattttcaagaaccccttttctgtattcgcgaaactttgtatctgaaatgttgtacaattcttttacttcttcagaaataaatttgttctcggatactgtatactcgtcgtcgatgtagaaacatctttcaatttccagatgagaaggttctgcgacttgctcgtagagaccgtatgcaattagagagtctttcgtaccgccgaaagccctctccagacgctttctcacagcgttgtaattatattttgtggagttcatcaactcctcccttaagttagttacatcaatgccatcatctattaagtcatctataaggagcaatgcgttttcttgtgtttgtgtaagaaccatctttttcacctctcatatataactgcgagtttaacttccggaatggcacatcttttctcgaaatttattccgtcacttatagatgcgtatgtacttcggaaaatggacaaaaaaaatagccgctgaacttaatcagcgacgtaaaaattttcgtattggtgagtatttattatgctgcgccttcacgtcagcgttactcatctgaacgtatttgcgcgttgttttaatatcggcgtgatcaaggattttctgcagcgtaaatatatcgccaccatttagtagatagtttcttgcgaaggtatgccggaacatgtgcggatgcaactcgtctaatttaaggcggactttcatacgattcaaccgtttcctaaacgcatccgcagtgaacggatctccatacgcattcataaatacttgatcgggctcgccgaaatattggcgtatctcttcgtaaagttcccggaccattcttccgacttctcgcgaaataggaatctcgcgttcttttcgattctttgcgatctgtgacggaaccaatacggacatactgcggaaatcaaattgcgatatatgtaccgaaacggcttcctccggtctgagtcccgtatctaacattaagtacatcaaaaccttatcgcgccactccgcaaactgccggtcatctaacgcattgaaaatcttaccgatctcttcatccgtcaagccgcgaacttctttttgctgatcatcgcgcaccggtttaactgattccatcgcattttttccggtaatgccttccgcataccaaaaacggcacatcgtctttagcgttcgcaagcgcatattaatcgtattgacggacaatccttcgcgctctattacttttcggtgttctgcgccttcatacggacgccggtctttccgcaggtagttaatatatgcgcgaataatttgcgctgttagagcgttaatgtcctcgatgacttccggatattcctccgataaaaattcgcgcaaatacgaaatgtggtgccggtaatctttaatagttcgaggccggagtccttccgcttcttttgcttgtacgaatatttccaacgcctcttctagcgaatatttaacgtcaacgggcatacgtcggtcttccggagaccgttggactcctcgattagccgtcggacgtctttccgtaataaattttcgtgccacgtctattgcgcctccttaatcgttcggtcgggcgccatttgatcctacgtacatgacagcgttagtcctacgtacaacgaaaaaacccgctatgtcagcgaatatgtcctcgttgattcaacgtagacaatccgcaatccataacgggtcatgatgggtacgtcccaggagagattcgaactcccgaccgacggcttagaaggccttacgcaaacaccaagattggtccggtaaatactgtccgcatcgtgtgttagcggaaggccgttgggaagccgtaaaagcggcaatcgcagcggaactcaaagcgctcggcggcaagtcttccgcaagcaagccggccaaggcatccggatcgacatacaccgttaagaaaggcgacactttgtccgaaattgcggtgaaaacaggcgtcagtatggcgaagttacaagcatacaatggcattaagaacgcgaataagattacggtcggccaagtattaaaactgacgggggcggccggttcttctaaaccgtcatccagcggtaagaaatacgtttaccttccggcgtctgccgactcatggcgcatctatcctacgaataaagcgccggtcaaagggaacgaaattaactatttgcgtccgaaaaaattcggcggccttaaatacgaaatccttgcgaatccgcaaacggacgtttacacgatcaagacggatcagttcggaaaggtaaatatctatgccggaaaaataacaggcgcaacagtaaaataaacgaaaagggagacgatgattatggaagaagtattgattttcgcgactatcctcgcgcccatcctaacggcgctcgttcagctcgttaagaaaacggttaagctgccgacgaatattgtgccggctctcagcttcgtcatcggtatcggattgggcgcgattgcctatccgtttactgacctcgacttggtgctgcgtttgtgggccggcggctttgcgggtctagcagcgacgggtctttttgaaatcggaacaaagcgagagggaactacgaaatagaataacgaaaccttttgcgggcgcttgcgtatgaatacgtaggtgctcgcgtacataaaaactcattgcggatatgtttggcggcgtagtataattttgttaactcatataaaggacgggtggctcaacgtggaatataaaacggtgactgtaaggaaacagaaatttggcgcaggtcgaatagtatgtttgacgatcggtatcctgctcgttttattcggatttctcttaagcttaacgattatcggaataattgcgggcggtatgttaatcatcttcagtttaccgttttttgcgatggctaaaggtggcgcgaagtatacgtgtcctaactgcggatataagcataacggagtagcttcgggaagtgtaaacgcaacttgtagacgttgtaagcaaaacatcgctgttaattggattggtcctccgtctaaaaataaatcagataaagcgttataaaacgaagaagccccgtccttaaccggatggggcgttttttacgtttatgatatccgcaaacctcacgaaatttgtatcgcctttggcgtccttcacgcgaaactccttccgtatgtggtccacgtaatgtactgcgccaattacctcgcgtatgtatccatcgtcataaagctcgaatgcgagcggcgcaccgaactccatcgattcagcgaccgtcatttccatatcctcgagctgctgcgcatccagctgcggcttttcaactttccgtttctcttcggcttggcgcgctaggccggctctgtgctccggtaatataatgcgcatcgcccatcgtttatcctcgatctccacggcgaacacctccgcatttattatatgcgaatgtatgttcggatatcaacagtcaaaataatcctctcgatcgacttcgtatcccagcgaccttaaagcgcgctgtacttttacccacgttgaaatacgaggcgcataatcgcgatcattacacatgctcgtcattgtgccgtgacctatgccggccttttggagaacttcctcctgcgcgattccttctcgatctaaaaaccggccgaatcggctgcgtcgtttacctagtccaaacatcagacaacacctcctaaaatcagcgtgtccaaaaaatcggaaagttaaacgtaggcaaaaaactgtgatattggacaatccgtatcgcgtaacgtttattaaacggcaattacacggtagctaaacggtagggtgcgggtaggttcggcagagttgcgaaaaggttaccgcacttggtggcgacttccgtaacggttattaccgtgttaacctaccgcactttatcgcgtttaacgcccgtaacgaagccgtttacgaaatttgttaaggagtgagagagatgagcgaagcgaaacgaaggaacgacagggcggggctcacacgagcgttttcgttcgtgcctggtggattcacagcggcaggatttttcgatatgtctccggaggtagtcggcttgtacgcgttagtgggcggcgcgggcttggtttgcatcggagcggcttggctagaaggacgcttgttcggcggcaaatttgcgtatattggagacgcagtaaacgggctcttgcggttcgtcctacctgcgggctatgccgtgttgctactgcgttttttaaacgcgatatgaaacggttcttgcgcaatcttcacgccaaacaaacgctaaagtacgcttttgatgccgccggcctgtacgcagccaaacgcctgtctaacggaaaagaagcgcgccgatatccgaaaatccatgacgttgatattagcgaagaaagaacgcggtatgtatttacgttgcttaacggaatggacccgaaagaaatcgcgaaaaaggaatttgtgttccggcaagtattcggacgcaacgttgaactaagcggcgatctaaaacgctatgtattaacggtttatagcgccgagatgccggccgtattgcgctatgactttgcggagattcaaccggtcattgagcgtcacaatctcggcattatcgcgggcaaagatcgccacggtcggtatgttagcttcgatttgttgacgcaaccacatattcttattgcgggcgaaacgggaagcggaaagtcaacgcagctacggtcgatcctgacgacgctgataaaacagaaccggcccgaccggctacagttatacctcgcggactgtaagaaatcggagttccacgtattccggaaagtcgaacacgtacagtgcgttctaacgagcgcggaagatatacgaagaatgttacgaagcataaaacgcgaattagatgagcgcagcaaccttacggagcaattcgaaataagccatatcgatgagcttccggatgatcaaaaacgaccgtatattgtcgtctgcattgacgagtttcttctattaagaaaagacgccgagatcatggacgtattagcggagctcgtcgcgataggccgtacgcttggagtattcgcgattctttcgatgcagcggccgaatgccaagacgcttgatacgactatccgcgccaatctaaccgtaagcatgggcttcaagctacgcgatataacggaggcccgaatcgtcaatacgccaggcgccgagaagctggacgtaagcgggcggttcataatggcggccgacaaaacctacgaactacaggcgccgtatctcgaaatgaacgaggcgaaggcgctgctgaatccgtactgtgtaatgaagtcaccgaccaaagacgtaacgccaccggcagccgagccagaaatcttaacggaaaaggacgtgtttatcgatggcccttactaaccgagataaagcgatcattgcggatcttaataaatttcgcgtaatggatcgcgatatgattgccgagctacatttcggaaatttgcgcagaccaaaatacgcagccaataacgttctgctgcggttacttagagacggacatattcagcgatctacggcgcgccagccttacgtttactttggcggcgaaacaacgatgaaaaagaacagcgccaagatcgatcattttcttgcgataggtaacgtttataaagagatgcgagggcaggcgttggagtcgttcttggtggagccgaagtacggcgataaaggtacggtcgagccggatatatttgcgctatatcggcggacgccgttctttatcgaggtgcagcggtcagtctattcggaaaaacagatgcgcgaaaagttagaccggtacgaagcgtttttccagtcgggcattattgcgctggaaccgtggcagaatccggagcggataatgtttccgcacgtattgattctgtcggatacgcgatacggattgccttcgtttccatttaaggtattccaggcgccgacctttactgcgtttattcagtcgataacaaagccgcaaccgcaaccgaccagctaaatttcgaaaagttcgtttgcatccgtaatctctaacgccaatacaattcgttcaagcgcgtccgatggatagcgcttcgttttattgttgcaaagttcgctaatcgttcgcgtagacagaccggtcatgacggcgaggtctttttgttcgatatgacgttcctttagaatctctttaagccgaagcttcatcgttaacacctccggttcgattacgttaagtataatttatttcgctgaattacgcaatatgtaattgacaatttcgtaaaacgtaattatacttacgttaaacataagttacgggaggcgaaatctatgcattacttagcggaacatcaaacgttcgactcgacggctcaacttaacgaagctgtttacgaacatatcaagcgcaatacatacgagcttaacgatacggatcgccgggcgcttaaaatgatcgcacgttacgcggtcaagtttagcggagcggcgcatcttaaagcggaaacgttggcgggcctgatcgataaatccattaagacggcgcggcgggcgctgaataaactagcggggctcggcatcgtaaagaaggtcgctacgacgaggaagatcaacggaggcaaaggcgcgaacatcatcgtgatcctgccggttggaagctgcgaagaaaacccgaaggacacgcttttgtccgaggatgaccagtcgacaatgtccaatcgcggacaagccgaaaagcctacggaatcaacggttgaggcgccgaaaacgaaaaacgaaccatcggatttaattaagcgttctaaaaaccaaaataacgtattagatacggcgacagtcccggctgaggcgttaaaaggcgcgttgcctaacgaaatctatgacgcaatggctcgttactttgacgcagataaaatttataaatactacggaattcttttgcgcgctaaggcaagcgtagacagaacgatcagactcgaagaacatgcggcgcctttcgttgaagcgtggcacgcaacgattatgaaagcgaaatcgcacgaaattaagcgtttcgacgattacctatacgctgggtttaggaaggcggcttggacggttaaggcgcgcttaaatcgtggcggatcgcttatggaacgttttaggaaggcgtttgaatctgcggagtgacctacgtttgacatagcgagtctcttctattaatatttgcgcttgactatttcgcctactattcgtaataatagagaacgtaggcaccattcgatcgtgaacgtaagactagcgtttgtacgtcggaccttgaaatccgattgaatcaacgttttgacataccgaagacataacgaaagcattattgtttaagtacaacaaaaagagccggcttaatggctcttttcttttgctaataaattagacattacttcattcacttttagattcactttcttaattgcatcagccgatggttgattcatgctttcaatcgttatacgatatttttctatttcaaacgattgctttgacgatgatttaacgaattcactcatacagcgctcacactctgctgttcttttttaatcaaatcatcgcaaagcttgttcaagtaatatgtatagttaacttttttcttcatcgaacggacttctgtgccgatctcttcacatatggagatcgggatactggatttgtttactttattcctatatgtatgtttcaattgtttttcagctatgttcttatatgtaaggaaatcattaatatgtacgaaataaactttgttttccggctctctaaactgaaatagaaaaccaggaattatgtttggatattgcgctgcctcttttaagtgtttaatctgttgtggcttgatgatcttttcactgaaggatacagacttgttctttgttgatttaagttcaaaaggaaataagcatcctttaaagtgcaggaagcaatcgtatttgttttttgatacagctgctccccttttcaaaaacattgggttaacatctttaattctatagaagaacagcttttgatctgcagctgatttttctatatttgcttcaaaaaccttgccttggtttgtacctcccaatcaatcactctcctaaaatattgaaaccaaaattgatattaaaataaacctttgttacactgttttatgttaattaatattgaaagaagtgtacgaaatgaagcaatggacacccctacgccctcgtttaaatgaattaatgtttgaatatgacctcacagttgatgaccttttcaaacgcacaggatatccgagacaacgtatccacgattatataagtggagccaaagcaaatatgaatttagctacaggcatgacttttgctgatgccattggttgctcaattgaagagctgtacgaatggaaccatgaagcaagaagaaaagttaaatcttaattccttttcgagcccatctgatttcctgcatcaattcttccttattatccgaaaggttgattaggttacggtgggctctttcgtattctttgttctcgagagcttctttcaccgtacccatttgtctttccattttgttgaacagtatttgaattgttttatgttcttcagctattatcctccacctctaatcatctaattttatttttactctaaatagaagaccgattttatttagaattctctgttcttgaaaatgtcacgataagtaagtccagaaatcccacgatcctttttcgtttgttcattggcttctttccaatcattttcagttaaattggaaaacttatttttagatagcttaggtttcttgactgctttaagtttaataaaactaaccccctaaaaattctttaattttatttatgtcatcggtattcaaacaaatcgacactttcttactgtacttcttgtcttcaatagtcattaaaacatggtctcttcctttctcgaaaataactttatcttctttaggaaaagtacgacatttaaaaacttttttcattgaaacaatcctccccaaattactccagcagcaactgctacaataatcattgaaataaacttagctattccaacccataccatcaacttcatattgccttctgaatcccaatcacctaacacaactagaccaaatgcaattaacaaaacccaagctgttacaatcatctacttagaacctctttcgactgtgtaaccactagtaatgtcatttaagatcgtgctgcttggggacagcttttcactctcaatatctttatttttagtgtaattaatgaaatcctcgaactggatcaaatacactccgtaagctgtgttattcaatctttcaatggtatcttcactaggtttagaaaaccagctgtcagtaccttggccatacacttcaaaaatctgaattatctcgtccttatactcaaagtaagccagtttattttcaagttcacattcctcatcaactggatttcctacatgatttgtcgcatattccatcattgaagtaagcatgtagcctaattcaatgtccgagaaacttaactgtggtttaggtgttccataataaatatctgcttcatttagtgatcctctttggttcacttctttaatgatctcttcgatagctgtgtagccttcatgaatgatgaattccctacgttcctcatctcttcgtttatactcctctaataaacttgttaccttaaactctgtattcttcatctaattcctccttgtatgaaccgattatttctggtatccgttgaaagaaagtaataatgcaatccctagcatcatgtgggtattcgcaatcaatttcggcacctgatatgtaaatatcatattggatgctgcatatcaggtgaggattatagggtagctcgtattgtaaatacctcttcaaattaggtaactgctcattgacaaacttcaagaatttcttttcatactctggaacctgttcatataatttttttacatgttcttcaattgtgtcggcttgcactttgtagagattctcgaacagtgctttgttgatatccataagttcacttaaagccttgacagctttctcatctccgctaagggtaactccccaccatttatccaaatgcacttaatcatcctttctatatagaatcaacattttattcattctccgaaaattgcctattaaaaagttcaatcgctctatcataggttgctaattgtgcgatgtgtttgtcaatattagtgccatttccctgtaatccatccgagatatataattgctgattgttttttaactttgattctaaattatctaacatgttacgaatacttgaaatttgattttctaatcgcagtttagcctgttctctttctgattcaagtataattaagtttctattttcttttgtcatattatattattctccttcagtataaaattagaatttcatttcatttgatttcaaatgtcttcagttcaaacgttttatacgtatcaacttgcttacctggtatctcatttactctaggatacatatcatagtcatatggatatccaatgcagttcatgtgaaagctcgttccttctttataaaactcagcttgtaaatgatcgtgtccacaaacccaatgttcagcattaataaatggcaaatcgaccatatagcagctgttaggctcaaacggagaataaggattgtgaacaggtgggacatgagatacaaatacatcaatatcagagttttcaagagtgtcataccagtccattgattctttccacattgctcgtaccccatcttctttgctgtatccattaaggctgatatagtttgaatcattagagacacctttgaagaaatcccatccttcatttccttttggaagataccacataacatctcctgcaaagactttccctttgtatgtatccgtagactttattaatggagtgacattattgatgtctgtagccttctgaattaaatcattcacccttcccagtgaatcggaatattttcgttgctgatttttactgagtaaataaagatcatgattaccatatgtgaagtaaaccttttcatactgctttgctacttcatcaagtacccacagtgtctgttgattccactcagtaaagtcaccggcaatgattaatacctcaccatttccattcgatattaaccttctaacaatctcccttgttcgcttttcccacttgatttggttattgttccaagggatccagtgattaatatgcagatctgaaacataatcaattttcattttatcccccttctttgtttaagtacgtgttaactcatgctccatgaccaattgacatttaaatcacctcacttcaaatttaatgtgtatattttcaaaacatctccacacaatacaattgtacaaacttgtttacatactactttaggagatgatcatatggctaaacaaaacagatcaaacaacagcaatgaattacttgtgcctcaagctgctggtgctcttgaacaaatgaagtatgaaattgcttctgagttcggtgtgaacttagggcctgagacaacaagtagagcaaacggatcagtaggtggagagatcacaaaacgtttagtacgtttagctcaacaaagtatgaatggccaatttcattaatgtatgaggggttaatcccctctatttttatactcctttcccaaacccgaacacccagatcatctcttctctcaaccatttataaattttttctctgacctctgtgtcatgccatccccactcttctgctaacaaatgaatatctttcggcaggtgtttatgtatttgaacaatagatgctgggtctggttttttgccataataatcataataacaatcgaaaatctggtcgtacgcatcttcgtctatccataaataatgacaaacagcacatcctgaaattccctttggacaaggtgttttaatcctatacctgccattgattttctccatagctcactatccttctctttaaaatacagattttatattaatttaaaagtgatcgttttcttttatcactgcctttcactcttgttttttcaaacattccgtcgtaagtccaatcatatccgctatactttttaaacaccgtcgtcttcaggcggctatgatacgtcactcaccgcccgcctcttcgcgtgagtcgtcgatgattttatagccgtatttacgcgcatctttcaagtatattgctgcaccgccggaaaaaggcggccaactgtcgtcttcaataactagtgctttgtgaaccccgctatcatccgatataaaatcgcccacacgaacctcagtcggctgcggagcgttcaagtattcgtcaggcaccgccaagcctagcgcacgtcttagcgcgattgctttaccaatgtgaacgttgaaacagtcggatggtgcggctttggcgattcctttcgacttcactgtgccccttcctaccgatttaaggagagcgacaacagtacttttctttttattaataacgaactctacgttacagacaatgcttcggtaaaaatatcgtaattctccatagaatgtcccaatatgatccgccaataacgatatctccaaaacgagatttataaccgaaatatttatcgtccttcttttcaaataccgtattcgcattattgattaccgtttgatttacgttttccattcctatctcctcctcgtttttaacttcgctattgacgatacggtacactcccgatcgccccgtaaacccggggcgttttcgccttcagatgctctcctgccggcgccgcatcggaaccgacggccgcggatctccttcagcagccaggcattccgtcctggctatgacaaaaaagccggcatcggcctgatctggagtcttgctgctcctgccgcaaggtctacgatctttccaagaggaaccattcccctatgcattcttgaacgccctgtaaacgtggtgtgtctttcgccgtcagcgtgtataccccttattgcctcgctgttcctgtgctgatggttcctgaaataaggatattccttactaaaaaagaaaagtaatgataaagttattcatacaaagagtgaaaagagggatttgaattggcagattttattgtgaataaggcaggagcaaaggtttataaagatattaataaacacagagtcttaaatgtaccagctttatcaaatgaaagtgagaaggggactgtatataatgttctttctgttggatttttaggaggacagagagaaccgattgtaactgttaaagaaactgatggagaagtggtagtataccgtttaccttatgatctagttggttggatagaaaattttatgggaatgaaacttcatggaatcgattcgtttccagcaaaagtggagtttggcaaattaaacggtagagtgtatgcagagattctgtaactgagggttaattaaggtgaatgaaataagttgaatcgttctgcttgttaacgtcaacaaactagaaggacagggctatgagtcactcggaaagagcgactcatagtatttagttaacatacaatcgcgattagaggcggtagcaatgccatttatgccagcgaattaataggtctcattctaatactaaagactttgcggtttgaacgagactgcttattcctctactatctgtcaaagtgaatggtttttcatacttttttgcaaattcttttgctttttctgctgtgggatgattgatatttaatttcatagtgattaacatgtcacaacttttaaccatactttcaagccgcttggtattttcattgccgtaagcatggatgagctctcccccgacactcgttattgctttttcaaattcactcgttctggtaccgcctaacactagtaccttttttccgttcaattcatttgttattgtggtggtatctaattttggatttttagttttataataggaagaaggagaaggtgcaacatgtttgatttcatccgtattatgtttccatatcactttgaaaacatctacattgtcactgtaataagctatatcaacaattgaaccgatctcaaggtcctcccttgttcttgtatcctcattgataagaaaagtatgtggtgcatcattatattttatggatttgatttttccgtcattatctaagtattcagaggcaactagcatagaatcgcgatttgacagaacacaataatttaattgaattcggtttgtttgcttgcgatttttgcccttttcaattaactcaaaatgaaatttttcatttcctaaatggactgctgaaattaaatctccatcttcaaattgttgttttcgtataatgttttcgggaacatataaattaatctcttctataattcctcctttcaaaagtcttttaaattcataacaatttatctgttttgctttttcgtctgtctcttttagttgaatatgttccacatttttttttgagcatggctctaattcatgagaaaccgatacttttaaagcagctaagctcttaataaaatgaaaataggtggataattcaccttcaatttcttccacgttgtccagtgtcagtttttgaattatctttcccatttcacaaacggcttcctgagcaatattttgtctgttcatggaaatcccctctctttaatttaataactgcactttaagaatacagtatctgcatgaggcatgatactttatcaatgaaaagaagcccttgataaagggctatgaattttaacgaataagatcgtgataaatgataaaaataattatataattgaactgcacacaatcatggccaatggtggtcagaccttttgccatattatcttttttttaaggagaagctgattttgaactcagtttctcctttttttatttgttttagcgcctgtgctaagtataaaagcattactaaaaacaaaaggataaaaacggcccaccagggcatatctgataccctagataacagcgcttctatgaaaatttgaaaactatttaacatttcttcacctcccataatattattatattagtttttgagaaaattacagaccgtttgttatcaagtaaagaaaccgcttacttgtgagggggaatgtatttattttgaaatagtcaactggtagtatatattacagggggtgatttgggggtgacgaaaggggcctcgaaagataagaatagatttactgaatggaaaagctctttttgcctatttattttccttttagacttaaagaagcttcctcttccttcagaagctttaaattgggaattgaataagctgagaactgaaattcgtttgatgcttgagaaacataacgaaataccaaatgaaaattaaagtgtttggtgtgattagttgaaaaaagggccatccagccgaagttaagatatttagtctttggcccgctcttatctggataaggaaaggagtaagaaggattttataggtgtgaatgttctgaggacaaggatgaactaagcttttgaaaataaacgtttccaaaaaccggatctttttttagaatcgacggcagctgctatttcgggatttttctgttctctattttcttggattgcctttaatagttggcgatctcttctttcaatttcattattcattttggattctaaaattgtaagaaatgtttccctttcctcttctaatgctgttttcaactgttcgctaatcagttgtcttagctcattgctagaaaggacaatatgtttttcattgctatcatgtaactcagtggagttatagtgttgatcctttttggcgactgtactcctaacagcattattaagtggcactgacgatgataggagttgctgaagtgattttaaacagttaatatcattttgaaaatatattcgttgatcctggtcgttccgtgtaaaagtgtagccggccttttccatttcaatagaccaccttctaagtgtagagggtgttatttttaatttatgtgccacgtcttttgaaaaaaagccatattctcctctatgattggtttcacttgtcataaaataaatcacctcagttatctattcaaccttatttttactatccctttaaatcctaataaaatagatatatttgagtggtactccaaaagaaaacgccccgcgtttacggagcgatcagggctgcaccggcagcgtcgtgaaatctccgcgtctcatcgaagctgcgggggcaaccggattccggagccgaccaggcgccggctttttgtgttctgaccagggcggaatgccctggctgctgaaggagatacgcggccgccggtcccgatacggcgccagcaggagagcatctgtgttctttgaaaactagataacagaagtaattcacattcaattgtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatacagttcagcacgcaagacatcgatacggcgcggttactcttctcgctaactaaggatggcgtcccattgccattgtctgctgttaccgggaagcttgtcatgttcacggcggacggaagtcggttcataagaagcgtagagatcacggataaagtcgaaggtgttgcgcagtacgttctgtcagccgaagagatccgacacagtggcgatgtgcaggcggaactttacctgtattatgccaataagcaggcgctttccatccataagttttcgtttaccatcgacaaggcactgattgatacagatatcgtaccgttggcggaatactacgtggatgacttcgaagcgttgcgccaacaaatcaacgacttatacgacgaagtggtcgaaacagtcgaagagctgcgcaagaaattcgaagacctcgaaaatattgaaacgaaagaaggagcgcaagcaaaagccgatactgcggaaaagaatgcgaagtcctatacggacactcatacgaaaaggactgacaatccgcatagcgtaacgaaatcgcaaatcggtttggggaacgttgagaacgtgaagcaggagacgccggatggtgcgcaggaaaaagccgacaaggccttaacggacagcaaagcgtacacggacgaacacacaggtcggactgataacccgcactcagtgacgaaagaccagatcggacttagtaacgtcgacaacgttaagcaggcgcctctcgaccaattccgggcccatgattccaatagcatccgtcatacttcgcaggttgagaaggacaagtggaacggatcgcagttgtttaaattgacgcaggatactggcgcggcacagtacatgacgggcatcgattttaatacggtaacagataccggcttctattacatgagcggcgcaacgacggcattgaatgcgccggtaaataacaacggatatcttctcgttcataactacagcacgtacgcgtatcaggaatacacgtcatatagcagcaatgattcgacgtcttccggccggcggaaatttatgcgtaataaggtcgcgagctcggattcatggacgtcatggcgcgagcttgaatcggtagaaggggcgcaatcaaaggtagatatccacgccaacagaacggacattcacgttgtacaggcggataaagacaagtggaatagtccgtgggtcgcaacgtggaataacgttactttgattaacggcgcgcagcaaaacaccggctatccgtttaagttttccgttgcgaataacgaaattaaactgagaggcacgttcggctcgctgccggccgccggtacgacggtagcgaaattcacgtataagccgacgcagctcgtagatttcgtcgttcctacgattggctcttacgggacggcccggttcgcatttacgacggacggcgaattacggttcgatgggctttccgcaaccgactcggctagcgttacgcgtgtgtcctttaatatcggtatcccattatggtaaaggaggaaataagaatgcacgttttatactacgacaaaaatttcgactatgccggcgaagaagatatcgatgtagaagtgctgccgccaaacagtacggacgtattgcccgatccgtcgatcatctcgccgcgattcgataagaagaaaaacgtatgggtcgaggcggcgacggaggaatacaaagagagcattaagcccgatccgccggctccgaatgaaatcgagaatcttcaaaagcagatagcggatttatattatcttatcgcgacaggaggaaactaaatgacttggtatctccgtatcaaaaatctttacgacgccggcctctggacgaagaagcaagttcacgacactgtcggagctggccggataacgccggaagaatacgagaaaatcaccggggatgtttacgatccaaacaagcctcctatcgaagaaccttcggaagaaacaggcggacaggaggcgtagttattgaacggcggcgaattagacgtactcaaatattttttaacgcagggaccgttcgcggtcctttttacgtggctgctgatttacgtaatgaagtcgaacagggagcgtgaatcgcggctacaagatctactcgataaatttagcgataagtacgacgtcatcatcgacaagatcgataggctcgaagaaaaattccgcggaagagaataatcgaattaacgcaacacgcccgtcaggtgagagtcccggcgggcttttttaataccaaaaacgaaaaggggacgatttaatggcgattttagtgcgtaagaatctagtgtctgcgagtaagtattcgattaagtgtccgaattcaatggatgcgcaatacatcacatttcataatacggccaacgatgcttcagcggatgcagaaatccgatatatgatcggaaacaacaacgaagtgtcttaccatttcgcagtagacgatacggaggtcgttcagggcatcccgacagaccgtaacgcatggcatacaggagatggtagcggcgcaaattccggaaaccggacgtctattggcgtggaggtttgttactcgaaatcaggcggcgccaagtacgaagcagccgaaaaactggcgatcaaatttattgcgcaattgctgaaggaacgcggatggggaatcgatcgttccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccaaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgcccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtttgaaccatgcggttcaaacaagcatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgatattatctctctataaatcaagtacttttttaaaaagagtaaaaataaaatcagtatattatttctagtgtttagaatggtcgggaagacaggattcgaacctgcgaccccatggtcccaaaccatgtgctctaccaagctgagctacttcccgattttcaaataaattatggcgcgcccgagaggagtcgaacccctaaccttttgatccgtagtcaaacgctctatccaattgagctacgggcgcaataaaataatggagcggaagacgggattcgaacccgcgacccccaccttggcaaggtgatgttctaccactgaactacttccgcaagtaaataagtaatgaatggccaaaataaaataaaaataacagcaccaaaaaagaaaactctcatgttatttattcagtaatgctaagacggtgtaactctctgcttaatctaaagtaaaagcctatccaaaaaccgaaaattcatacggttcattatgacaaaagtaattatatcagggttttgatgaaagtcaataccatttaaaaattaatttataacgaagaaaacagacttcatcagaaaacctgctgcaattagcactaggtttttactgctttaaacaaaaaataacagttccataacgtacggaaactgcttcagatcaacgtattttagataagcttccaagcgggctcgaaccgctgacctcttccttaccatggaagtgctctacctgctgagctatggaagcaatggctccgcaggtaggactcgaacctacgaccgatcggttaacagccgatagctctaccactgagctactgcggaatattataagcttcataaacaaaaacatggtagataaaataaaaatttcaaaagtatgtatggcgcgcccgagaggagtcgaacccctaaccttttgatccgtagtcaaacgctctatccaattgagctacgggcgcagcaataagtgccgagggccggacttgaaccggcacggtagtcacctaccgcaggattttaagtcctgtgtgtctgccaattccaccaccccggcatggatggtataggtatagttggagcggaagacgggattcgaacccgcgacccccaccttggcaaggtgatgttctaccactgaactacttccgcgtttggcaatgcggatgaagggacttgaacccccacgtctgtaaagacactagagcctgattctagcgcgtctgccaattccgccacatccgcaagaaaaacatggtgagccatgaaggactcgaaccttcgaccctctgattaaaagtcagatgctctaccaactgagctaatggctctttttacaagagacttatatagtataacatataaaagtggtgccggcaagaggacttgaacccccaacctactgattacaagtcagttgctctaccaattgagctacaccggcctgatatgtcaacttatgtatgataggaatggtggaggatgacgggctcgaaccgccgaccctctgcttgtaaggcagatgctctcccaactgagctaatcctccgtatattacacttacgtgtaatgtattacacgtaagtgtaatatacggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcaccatttttggacaagataataatataagtctttttaaaaagagccattagctcagttggtagagcatctgacttttaatcagagggtcgaaggttcgagtccttcatggctcaccatgtttacgcgggtgtggcggaattggcagacgcgctagacttaggatctagtgtcttatgacgtgggggttcaagtcccttcacccgcattatacaggatagttgtcctgtatgcggaagtagttcagtggtagaacaccaccttgccaaggtgggggtcgcgggttcgaatcccgtcttccgctccaactataccatccacgccggggtggtggaattggcagacacacaggacttaaaatcctgcggtaggtgactaccgtgccggttcaagtccggccctcggcattcattattatgcgcccgtagctcaattggatagagcgtttgactacggatcaaaaggttaggggttcgactcctctcgggcgcgccataataaaatatattggtggaggatgacgggctcgaaccgccgaccctctgcttgtaaggcagatgctctcccagctgagctaatcctccatcatataagtgacccgtacgggattcgaacccgtgttaccgccgtgaaagggcggtgtcttaaccgcttgaccaacgggccctggtatttttcatttgttatgtattaataattagtggcggagagcaagggattcgaacccttgagacggggttaccgcctacacgatttccaatcgtgctccttcggccactcggacagctctccataaatggctccgcaggtaggattcgaacctacgaccgatcggttaacagccgatagctctaccactgagctactgcggaatgaagtctgcctggcgatgtcctactctcacagggggaaacccccgactaccatcggcgctgaagagcttaacttccgtgttcggcatgggaacgggtgtgacctcttcgccatcatcaccagacattttagtgacatgtattattatactatgtatttcagaaaaagcaagagtttttttagaaagggagaacgcgtataaggtcgatagtccggatagggcgttgtatattcgaaaagaggatgctgagcttatcatcactgaaaatcgtcgccccaaaaccgacgagcgagtgttaatcacagaaggactatcgtcatcaggcgactataagactggcgatatctgcacggtacgaagagtagtagacatctacggtacgattaccgtgaaagaacactctaattttgtaatagcaagggaatacgaagtcggtacactcccgatcgccccgtaaacgcggggcgttttcgccttcagatgctcttctgccggtgccgatcggaccaacagccgcagacctccttcagcagccaggacggcccgttgcctgccctggccacaaaaaagccggcgcctggctggttccggaatccggctacccccgcagcttcaatgagccgcggagagtccaccgcagaggcgctactttgtgtccgggcaggcaacggggcgccctggcagctgaaggagatctgcggccgtcggttccgatgcgacgccggcaggagaacgtctgaaggagaaaacccccgcgtttacggggcgatcgggaaagcactggcagcgccgcgccgtgaaatctccgcggctcattgaagctgcggggcagccggattcgggagccggccgggtgccggccgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaagtaaatggcggtccggacgggactcgaacccgcgacctcctgcgtgacaggcaggcattctaaccaactgaactaccggaccatttttatttttggttgcgggggcaggatttgaacctgcgaccttcgggttatgagcccgacgagctaccgaactgctccaccccgcgatgataaaaggcgaaaatgccccgcgtttacagggcgatcaggaatgcaccggcagcgccgcgccatgctccgcgtctcatcgaagctgcggaggaaaccggattcgggagccggccaggcgccggcttttttgtggccaggtcaggcaacggatcgccctggctgttgaaggcgatcgggaaagcaccggcagcgccgcgccatgaaatctctgcggctcattgaagctgcggggcagccggattccggaaccggccaggcgccggctttttgtgtactgaccaggacggaatgccctggctgcagctgaaggagatgtgcggccgtcgggtggagcctagcgggatcgaaccgctgacctcctgcgtgcaaagcaggcgctctcccagctgagctaaggccccaaagtggtcgggaagacaggattcgaacctgcgaccccatggtcccaaaccatgtgctctaccaagctgagctacttcccgattgcagccagggcggcccgttgcctgccctagccacaaaaaagccggcgcctggtcggctctggaatccggctgtcccgcagcttcaatgagccgcagagatttcatggcgcggcgctgccggtgctttcccgatcgctcattactgcttgttgaagcagctttattatcttaccactcagcttcttttatgtcaacaactttttcaagttgttttcgaagctttttcttgttgtctgctgttcatcagcgacgaataataatataccatgggcgccatatcgggaccggcggccgcggatctccttcagcagccagggcggcccgtttcctgctctggacacaaaaaagccggcacctggccggctcccgaatccggtttcctccgcagcttcgatgagacgccactctcaatggtttggtggcgatagcgaagaggtcacacccgttcccatgccgaacacggaagttaagctcttcagcgccgatggtagtcgggggtttccccctgtgagagtaggacgccgccaagc
